United States Patent 10,900,036 (RNA INTERACTOME OF POLYCOMB REPRESSIVE COMPLEX 1 (PRC1)) - sequence listing, part 4

SEQ ID NO: 7046 - DNA, 1224 bp, Homo sapiens
ccccacgccgtatccagcacgctgtcctcccgccccatctttgtgccggccatcgtgtggtcgcgtctgcgcgctccgcccggtctgccggcgtgagaaagagctcgtgtcgttcccaagttcagaccagaggggacggcgaagcgcgaaaaagttccctgcgcccagtacgcaggcgcagccgtgctcctgggcttcccgggcctcgtcccagctggcgcgcccggcgctcctccgccagcgggcagttgggggcgctgcagggagggcacccgagcgggttgggggcgctcggaagggtggcttgcaaggtccgggtagctgcagtccccggagtggggcggagaggcgcggcaccgcgcggacgaggatggggcgggggcgggcgcagcccgagggtgcaggcacgataaggcgggtgacagccagcggggaggggcgggcgccaccgcgtccacgccctttgctcggggccgggccgggagggtcctcgggctttgcgcgcgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcaggtagggtcctccccggccacttccctccgccgggcctctccttctccacacgcggggtcccggggcgccgagagggacacggccgggccgcagagcgcgtgtcaccgccgcctctcctgggccactcctaaccccggaggagggaggggatcgctcacct

SEQ ID NO: 7047 - DNA, 1468 bp, Homo sapiens
cacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaagtgttggcatctcatttcatctctgaggacaggcgggtgagtgttctgtcctgggatggtgtgtctctctcacctctcatcagggcaataacccgtcggttacctaggccacactgtccccaacgaaggtgcat

SEQ ID NO: 7048 - DNA, 1191 bp, Homo sapiens
gaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagctt

SEQ ID NO: 7049 - DNA, 1246 bp, Homo sapiens
ggcttgatctctgcccccaattgttctcacagaggtttgcctttttcctcaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattttaagtaactctgggtcagtgaaaacattcgacatatattttttttggctgcatagtagtccattgagtaga

SEQ ID NO: 7050 - DNA, 1222 bp, Homo sapiens
cttcagttcctggatggtgtgaggggtcttccatgcagaagtcttcagacactcctgaagtgtgtgattcttagtttgtttttttttgttttgttttgttttgttttgttttttttaaagaattcctggtggcaatatagacaggtacggagaccaggtagaaaaagtgggggaaatgaacaattaattacacatggattggtgatttgggattctattctttctgtcaacgaaccataaaatttaatgctaccccttaggatgctttagtgatttgtcggttgaggaagaggtgtgtaaatgcaatagcttttgaaattgcagtggaagactcattaacttcgtgtggtggacccagggttaaagagaagccttaagatggtttctgaaggaggtaaatagagccctgctgtcacgaatgcctgatgtataggaaaatcgtgtagtcttctttcttccccaattgtttccatggatttagacactagaagtgtctctaaatttatttcattctcataccaaaaaaaaaatgtggtttgtttggcttgtaaagtatggacataaaaaaagatagcgggccatgcacagaaaggcagaatttaaaagctagctatagtttttttagagataagtggacctatattttttctcttgcctcatactgttcaagtcagggcttttattccatatttagccagtttctgcacatcctgacgtttttcatagggtactaggctgcagtattgggctttagggatcgtctgaggggagtccaactaggatttctgctgcttcagcagcccagcccaggcttgtcattgtgtgccctgcctgttaagtaactcatcacagaactgttattctccacttggcaaaacccagagagccagctcacctcagattgcaggtttagtaaactaagcaggagggagtgctgaagaccaatctcaggcactgccgcacaactcgggactcaacacccaggctcaggacatgtatgttaaagcagtttattcaaaatattgtttaaaattatgtttcatttacatttgtgtccataccctttccccccatattttgctctttccccctaaattgatgatttgcacttcaagcgtgcctttcctttgagcttcttaaatgctttaaaattttaaccatgttaagtctcccctgggctttggtacgttggcagtggatggagccgcagaagagaggaagg

SEQ ID NO: 7051 - DNA, 1160 bp, Homo sapiens
ttagccatgccactcacatgtaacagtggggcacttccatgctggttgttaaatatgctctgccttgagaccccctgagtgccctccggttcctagctgccctggtctttccttgggatctctttcccatgttcagcaatcaaagggttgaatcctgacacttgaggggcctcttggacccacttctgtgcctgtgccatagtgaacatgctgattgtcacccctgcaaatgtgccacttggatagaaggaggcctagccccacttccatgatgggaacaatcccttttccctctgagtaagtcttgattcactgttactgttgagagttctggttccaccattgtaatcttgtggccttgcctctagactgccttatgggtgaggtgtttttaaggaggagggatgtcttggtacttccatatgcaaacccccctgaatgggtctgggataggctgggcctggcggggaactctcctctatggagaattacattgaattcattgatgtgtgctcaccagtgatcactcctgtccttagagtggaacttgaccttgttctcttaacagtgtgaagattcctttaccttggccctgtgcttgatcttcatgatgaacccagtatggagttggcaggaaagctgtcttcagattacctgcccagtccagaaagcctctcccacctttctctattgtaaaccatggaaataaaaggggctcaagacactaatccatcttccctgatgggcccccacctttctagggttccctgctctaagcaggtggcactgtgctcctgcctggctcttgcctcctgcagcacagggtgaaacactggcatttttgcacttagtcatgtctactagtatgggccccagaagcatggggtgttttatatggattaggtttcttagcatgctgaaatgtagatgacagtgattcatcagggccggatttggagataaacaaaaactgtcacatagagtctcactcataggcttacatttaaaaagctttcccaggctatgggagttatatgagccccttgtctcactgaggcgggctgtcacaaagaagcagttaagggctggctgcctgggggctgggaaatgggccgatccctcatggctcagcctgcccttgctggctgcttgccctggtc

SEQ ID NO: 7052 - DNA, 1239 bp, Homo sapiens
tggaacatatgcagtacaacacaagtgtgtttgcatacatgtacaaacacacatgtgtatttacctacatttcaaggtgaaccctccccagaaggctctgctcaatgagactctgaaagtgttcaaaagcatggtctgagaaagcatccctccttcagggcatgtacccaagtagtctttctcttgctggctgaaatcatcagggattgtttccaagttttaacttctgattttcactcttttaaatcccagagccgatacttgaacagaagtaagtttgctgttacacctctcactttgattagcttgttgcgttaaattaattgtcagattgcctgaaaccaaagcttcttaaaatgaacactggttcactcgggaaatttttgcaagatcaaaaatggaagactgtgtcactgatgaaagggagagatagccagaatacaaaatctagagctttggacctgaaatctggctgcaagatggttttttcctgtcttacctaagaagtggcccccaggattcacataccagtagcctctttttgttattcttttttttttttttaaacatatccccttgttaaagatcctcttgattgcaagcaaaagcagcctactgtgcaggctggcttaagcagaaaagggaatttattgtggggacatggtggggaggtgtctcattactgagaggaagaaggctggctggcctcagaaggcatgagaactgggacctgggtccagcccagtccatggtggccacagctggatctcagctctgctcctccaggccaggtggctgctttctcctctctctgcagtgggattttctctgcccaggactcatgtgtctacctgtgggtctaatctcctagcataggctgagcctgcacctccttgagaaaacagattagcttagcttagtctgagtgttcactccaggcgcaccctgagagggagtgcagcctgcacatggggtgggtagttcttaaagggagcctgcctccagaggcgccgggggagggggggggcctgcatttagagtgtgtgcgtggagcatgtagcttgttcctgttttcatggagtcgcagagatcagaaagcatttatgcctgtttctgacagagatgcacacagctggtctgaatgggcaggattggggtgagggcagtggaggagggatctggccacacaggcagtctgctgtgagggccacttcaagccactcttcccttgctgagctg

SEQ ID NO: 7053 - DNA, 2070 bp, Homo sapiens
tgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcaccttt

SEQ ID NO: 7054 - DNA, 1353 bp, Homo sapiens
gtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaa

SEQ ID NO: 7055 - DNA, 1163 bp, Homo sapiens
ataatttgaaaattatattgcaagtattttgaaggcaatgagctttatttaaaattctgaaatacttttacactctaaaagatgaactgttcctagaactgattggaaatgaacttgttacttgatctggggcatgaactacagatgtccaccctcgatacatgaaagacaaaattggtctatagttttctccatgttcaggattaaaaatttaagcaaaatccacacacacacatatttcttaaattctgagggaatgctatgttagacacttaagaccatatgtgtgtgtgtgtatatatatatacgtatatacatgtatatatatacacatatatatataaaatgatcttaagaaacttaaatacttaccgtggttgaattttcgttggaagtgaatttttatcttaaaaatctctttttttggtccacaaagccagttactctatttggtgttacacacaaatgcctcttttcaccaataaacgtgtcttctattcaaggtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcaggtaacccatcagccgccggcagctccagcgagcctgaaaccaaattctgagagccgggcagttacttggtggctcgcgtgatcccagagatgctgtcgcagtggctagggaattgcttcctgtgttaagactaggagtcggggctcccaaattactttgcccctaggcagtatgagacggcaatatgagaattcccgttttgaagtctggtggcgtgctctctggtgctgttgccatctgcttgtttccccagtgcccatgctcacggagctcactacagtgagactttttggtccagtgcctgatacttaattggtgcgaaccccaggcttttgaaatgcttgctggtttagcttaaaataactgaaagcattacccctctatggtgcatgagaaatcctttgagcataacttctctgcttccctgcttggcctttgtagctttcctataaaacacaaattttagaatcatggcacgt

SEQ ID NO: 7056 - DNA, 2808 bp, Homo sapiens
gcactgagataaattgaggtcagggaacctctgagacagaagtaggctcttttatctgggtcgttttaaatgagatgctgtttttagattatacgtaactgaaaaaaagaggctcgtcttacttccatgtttttgtcccttctacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaag

SEQ ID NO: 7057 - DNA, 1276 bp, Homo sapiens
ttacagataagcacagtaatcaattcagtgctgtagtaatgatgagaccatggggtgacttgaggggaggcccgtgcgagggcctctgtgtggggcacacatccaatcctgcagtcaagatgatgatggctacctttaggaagttgtcagtgttcggatatttcagctgttgcaaatttttgaatggctgttttttttttttaatttaaaatttttattactataaaaatgttccagctgcaagagctggagggccaccatacgtcattcactgtggcacatctgtcatagagctttgccttcctgttaccctggatcgggctcttgttttccattgacctgcaccccactattattagccatgttgtcctgcttgcttccctttgggaagaataggcttagcagagctgactttgatctgataggcaaatctttgtcttctgtgttggtttttgcttgctattcctagtatgtggcaagaatagcatgactttgcatggtattcctagcacatggaacctgagatagctaacagtaggccctgagtaaataattgtggaatgaatggctgacatccatacagtgaacagtgggaataaaggagaaggagcatatttattttccaggggcgtctggaaggaatccaaaggtggtgtttgaactgagacttaagggatcaaaggaatttcttggggaccgaggcaatgggtgagtgtttcagacagaggggatagcatttgcaaatgcactgcatttgggaaagcatcttgtatgtagggaattattaaatgattctgatttctagggtatgaagtgaagctgggtgtggtggctcacgcctgtaaccccagcactttgggaggttgaagcaggaggattgcttgaacccaggagcttgagaccagcctgggcaataaagtgagacccccatctcaacaaaaaaattttaaaattagcctggtgtgatcgtgcactcctatagcctcaggtacttgaaaggctgaggtgggagtttgagcccaggagtttgaggctgtagtgagctaggcttgcaccactgtactctagcatgggtgacagagtgagaccctgtctttatgaaaagaaaaaaaaaaaagaggaaggagatgaggctgaacagtaagcaggaaaatgattaatattttctgcagagccatttagatgttaccttttttttttttttttgtattgtgagttgctaccctttagtgggtcctgaaattaattggcaagtcaagattagcacttttttttt

SEQ ID NO: 7058 - DNA, 1143 bp, Homo sapiens
caatatcatggaatcttcagattaagtctattctcttattgctgttcccacatatacatgaatcacataagttttttgcttgattctgtataaaggacagaaatcaaaaatgtataatgaaaggtgaactattatttaaagcagtgattcttaactaggggtgcacattagaatccccccagaactgtttcaaagtatgatgtctatgttgtactatgaagattctcaatcaggacctgggctcagacatttaaattttgaaaaaaatctccccatgtgcttctgatggacattgctgattaaaactcactgattacaaaatgactacaattagccacttaattgggcagtcctgaatttgaaaagtgactaggtgggatgccacaaatactctgtacctgttgatactagtgcaactgggtttccttacctaattgaatggcaatgtctttgactatcagatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttaggtaaggagatgccatgctttccattcttagttaactattcttacttaactaatctggttaaaactaagacatgtagtcttaattgttggtaagaagagctagttaatatgggacttaagatgaaattttcagctctaccactactaacctacgaggtgagtgtgtttgaatcacctgctttttaaaaatttgttaccacgtatatggtatggaagtagttatgcttatcggattagaaagtttcataaaatatttcgaagcacaatattgttgataaaattcttttatttttattattatatattttttaagacagggtctcactctgttgcctaggctggagtgcagtggcacagtcacagctcactgcagccctgaactcctgggctcaagcaatcctcctgcctcggcccccccaggtagctggaaccacaggtatgcaccaccacaccatgcaccacctccagctaatttttgtatttttttgttgagatggggggtctttccgtgttgcccaggctggtcttg

SEQ ID NO: 7059 - DNA, 1208 bp, Homo sapiens
tgcaaagtgatatttttaccattttagtatgggtctaagcaaggggtgtgtgtgcatgtgtgtgtgtgttgtatgttttaatgtattcatacactaatcatgggcctttttcttagtattcttacattcccgtgcatgtgactttccagttatgtaacttgctgttagaaaactttagattcccttggttcctgaagtacacagaagtggtgttcattttcagagtagaaactgatgtgcctttcagaatggctgacaaattttgggggtaagaaagtatgttacatgtccttagagagagagaaagaattgatttatgaaatagtacttttaaatttttcttcagatttggtatcattaccgtaattggtagacagtaaaacctgtcacttgaaaatgagcatctgtcacgttaccattaataacgttaacgtacgctaggcctaagactccctgcagtgacccatcttgtttgaatgaattgtctttgtgtgtagataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaaggtaattttcaggaatgcaatcttgacttttagaagaggtctggccattccattccatttagggagccacatttgaagccttgtaatgttcagcctcacgccggtgaagagcaggcctatcactgagaaaaagttagctttgttccccaaatacttgttcatctgcttcgaattttggaattgggaggacctggaaataatctaaacctttccttctataaatatggaaaatgaggcctagaaagttgcataattactgagagaaggatctggcatttgagtacagttctccacttcctggtctgcggcactgttttggctgtgccagctccctgatccagcaaaggcaggtgggcagatgagcagtcagcagtcgatgagtactcccgagatgcatggtcttgttctaattgtatcaggagtataaaaatgagtacagtacacgtcatgttcacaggagcctgtagtc

SEQ ID NO: 7060 - DNA, 1173 bp, Homo sapiens
atatcgtgtctgaagaggtgcatatacctaaaacaaccacaaacacctcgccctgtgagggtgacggaatcaattacttaatcacggaaagcagatgtgatgtgagcgtgaacatactggactggagttcagaaaacatgacggggttcaactcctggccctggccctgtggctctggccatgctgtcacctcttggagcatctaccgcttcccttgtggagggggctggcgtccccatgggtactggccagcctgtgaagctctgcacaagtctccagcttctcccctggacagtcgcccaaggaacagctgtatgaggaagggcaaaatcagcatcatttcatgagctgcttctcttttttcatcttaggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagcaaagctcagctcatttcactaacacttttcagcttactatatgtattaaacttttatgttgacttttgaattaaagtatgacaacactgaaagctctggatattaaaagaaaatgaaaagggcatatctacgttacttgtagcttgctttaattaaagttgcctcaaacaagtacaaatttgaaagagatatttaataaattagctagcttactttaaatgttggccaccctagggccttaattaacaaaaatgaattagtcaagtatgtgcaacaaaaagatgctgtgtgatgcaccataaatatgtgtaagaattcaagagaagagaaatttagagtaagtaggtaacaccagaaaccttggcaagtagccacctctggaagtgacatgtaagctgagaactggattgagcaggagccagcccctagagtggcagggttggagtgacggaggaagggacagtggagtgcagtgtgccaggagaaaatagtgatcaggac

SEQ ID NO: 7061 - DNA, 1108 bp, Homo sapiens
gtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatcttttttaaaaaaaatattttccatgttatagggaaaggacaaagagacttttatcagtttgctttttgtcttgtggctgtacatgctgttggcatagccctaacacagttgttcacaagttttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggtattaaaatgtatattatgttcaatatatagttatattttcatagaggatcatttctctaaatgaa

SEQ ID NO: 7062 - DNA, 2207 bp, Homo sapiens
gttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccagctgtcttttttgtttttcaatcctttatcatacattggctttccgaatgatccctttcatcagataaagcttttctggcttagtctaggacatttgttataactttttgtaaatgataatgaaggaaagagaacagtaaacataggagttcaaca

SEQ ID NO: 7063 - DNA, 1202 bp, Homo sapiens
tatataaatttaccaacactcataaaaatcttactcagaaatcttcagaggtttgctaaggatacaatttgattcttacacatttaatgctcaccagctgcttaggcccacaccatttatccaccctgatttgctactgctctttgaaatacaaccagtgtttcagccagactgttttcctgcttctgctccccttctcctcctcccagcacatctgtgaattctttgactggtttaccactcccacactcctccccagcaatgcagatcttctacaccctttaggatctaagctaagtctgcttcccagatatcctcccgaactctgaatgtcctttgatctctcttttctcaaaaaccttttataccttttattcccaaattatcttctctagaaatctgtaagggcaggggaaggaaaggttttatactattctgtcttcggcagaggacttttattattgcttgttacgtacagtattagtcatatcttgctaacactcagtgaactgccctcagctgatcctctgccctgtacctcacctctgctttaccacctttccatccgatttctaaaactgtagtgggactttttaaaaagtgtgtgagagttttaatcctgttgtggtaaactcgcctttctttgcttgctatactgtttctagtccctattttccagataaaaatagcccaggtcagcatggcttgcactatttttaactccaggtactaggagaaaggtttgctctaaaggtgaaatgaagttttatgacgttgcttaggccaaaagtcagttgatgaggttatgaactgcaatagaactttacacatccatgaatctaatggagagggcctgcatatcttatgtccctcacccctaccaatggtgtgtgaatccttcaaaacaaaacagcataatagacataatgttgaaagtgacttctttatataccctttttataagacctagaagaaaaaagcttgtagctagaaagcagatgcaaagttcaacattgataccacgttgatgtgcagagtaaaattttcaagagcaaaattttaagcttctaaaattatcatggatttgatttggttttcgaactgtaatttactcaaaatgtcaattacgtggaaggaggtttaagagttgtatttaacaaaagagggcatgagttaattaagttgagaaatatttcttttat

SEQ ID NO: 7064 - DNA, 1100 bp, Homo sapiens
gtgtgtgtgtgtttttgttttgttttgtttttttaccagccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatgg

SEQ ID NO: 7065 - DNA, 1185 bp, Homo sapiens
cactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagtaaattctgtttttttgtttgttcgtgttagtgatggtgggttttttggttttgcaactcacctgtagtcaactcactacaggtgagttggtgccattgctactgatatatctccacagttcatgtcatactaatactgtgggtgttacgccaactctgagtctcacttttaaaaatacttactatgatggcatcatgtgtggtaacagttttcatctttaatagaaaaagaaactggttctaggtcacatggtaagttactgacaaaattctgaaagaatattgggttctttcataaataatttccagcatgtattacatcagtgaatttttttatttttttagac

SEQ ID NO: 7066 - DNA, 1518 bp, Homo sapiens
tatataaaggctatcttagcaccccatgggagcagagtgggatgaaagaacagggtgtgtggagtgttcattcccatccctttgtcatcagcaggaatcaggatcagaaaagtcccctcactaaagaaagtcaccccttctcccctcaaaaagtacataagtaaaaataagaatcaaagattctcgtagcccagcttaggaggaatgaatgtatcgatcagtctccatgactcagtttatttctgctctgaccaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacata

SEQ ID NO: 7067 - DNA, 1271 bp, Homo sapiens
agccaggctaccttaatagttaatgctggtacacagctgaaaggcatggttcttggcttagaggaacttgaagtcagtgagttggtaaacagcaattagagataaggaaaattactctgttggatatagatggagtgctgtgggatcacaacattctttgcttagatgcaattagggtgggagacatcctaggaaagtttcttagatgagttaatacctgattgtatggtgtgaattttatctagctatgtagagaaggaagatggtgttccagggaggagtgttacgaacagtgctgtggatcatgaaactttgtgggcagaagcagaggggaaagacagatacgaaatttatcatagaatgtgttcaacttgaagcatattaattgctaatggctacttcctatctcttaattcaggtgaaggaaatactcatgaccagccagatgtcttaaggaatgcttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtac

SEQ ID NO: 7068 - DNA, 1922 bp, Homo sapiens
tcatttgttaatgtttcttttagtaacattcagaatatcaaagagaaaaataagtgaataaacaaaaaataaaaagaatatcaaagagaaaaattgtttgttacaggaaaactaatctttcttccattttcttcctcagaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaatttatttcctagaaacgccttttgtcagaagtgtggactatgataaagcagagttaaagcagcgatcatctgtgaacactcatacccttgagtcatatggagaccagggaggttgaggcaaaggttccgaatgaagaggggtcatcagcctctgtgccgctttccgtctctgtactcccctcgggaacacatttggcaggatgcagagccagcatccctgtgaggctcagaatgctcaggtagtaggctttaatttatttttaaagccatgaactaggccataatcattcacagtaagtttatggccaggtgctatggctcacgccccccacactttgggaggccaaggcgggtggatcacctgagctcaggaatttgagaccagcctggccaacatggtgaaaccctgtctctactaaaaatacaaaaattagctgggtgtggtgacatgcacctgtaatcccagctacttgggaggctgaggcaggagaattgcttgaacctgggaggctgaggcaggagaattgcttgaacctgggaggcagaggctgcagtgagccgagattgcgccagtgcactccagcctgaatgagagaatgagactccatctcaaaaaaaaaaaaaaaaaaaagtttatatgaagtttttcatatcacctttgcacacagagatcaaatagtggttagaaatagtctatattctgacaactatgaacatggacctaaaggagttgaattactcctgtatatctttatcgcaacagaatggaacctgtaagtgttgattgtttctgttctttcaatttttttcctctggcatttattacttaattatttatgagtaactatttatcactacccagcaatgaatttcaattatatctgggtccttttaaataatatttaaatttgagcccattacctgtaaatattttcttctgcagttttctttagaaatgactgttttgtagaagggttgcaaagagagtacacaaagttttcatacacccttcacccacatgcctctaatgtgatcttaataaccatggtaaccttcatcaaagctgagaaagtaaccattgataatggctctcttcactagactataggctttattcaaatctcccattttccactctgttttccactctgttttctgccccaggagccaacccaggataccacattgtgtgttcccttagtctcctcatatctctgacagatcttcagtctttccttgtctttccatgacctggacacttgaagagtactggccaagtattctgtgaatgtcccataatttgggcttgtctggtgttttctcattagactgagtttgtgggttttaagg

SEQ ID NO: 7069 - DNA, 1169 bp, Homo sapiens
tgctgtttgtaagatacatcattattttatgtacttccaaggaaaaaaatgttaccaaactatgatactctggattctaagatgtgtctcaatttcagatatgctaaaacgtgaaaaaacgtgtatctcatgtttccatgaagtatcataatatgttggttaataaagctgattttgaaaacttaaagttactactacaaatgggaattgtgtctgaatccaactaaagttttttacttaatgctttgttaagtctcattctaaattatctcattctaaattatttcacattcttaaaaatacatatacatgtatacataaatatatagagattcagatttatttatatgtgggattgttttctttttccttcccaggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggtaaagttggagttttctgggagctttgcctgaaagcttttggtcttcaacattttttaattaatccactgccacgggagcttcaaaggaatgtatgcgacatgatgagcttagcattgtgctgggaacaatcttaatgatcccaggtgttctgtgcaggactgtgcaggacctgtgaggtatttggggcttcagtgctcgttgttggcagccttcagtgtatcagcgacaaacagtttcagcacctcagtgtctctgcagaacagtggcttcctctagtggaggtgggtggaaagtaatttattattaaagttcttaaaacaagcccgcacatgtacccgtgaacctaaaataaaagtttaaaaaaaagtttgtatttgtaaaaatattttatagtgctctatctttgtgtattagtccttttgcataatttataatagtgcagtctttaatcatttaagaacagtgtttaaaaataacatacagctcacttctgtttttctacttatttttttataggtcacagttttagaaatcatcaataatgtagaattctgttcagtaaaacatatcctgttacagcccactcttgatgtagga

SEQ ID NO: 7070 - DNA, 1197 bp, Homo sapiens
ccaggcgccatggctcatgcctgtaatcctagcactttgggaggctgaggcgggtggatcacctgaggtcaggagctcgaggccagcctggccaacatggtgaaaccccatctctactaaaaatacagaagttagctgggtgtggtggcgggcgcctgtagtcccagctactcgggaggctgaggcaggagaattgctagaacccgggaggcggaggttgcagtgagctgagatcacgccattgcactccagcctgggcaacagagtaagactccatctcaaaaaagaaaacaaacaaacaaaaaacatgtaagttaaaagcaactaagttcagtgtttgaagtgttttatttaaaaatttttttatttttcttaatcactcagcccaaaatgtcaatgtttgaaatattttaaggtgccattctttttctcatcctcctaactgctttttgggggaagaaaaagcccctgtgcctaatttaagccacttacatttcaagttgtcattgattttttcattaatcacaaattcaatagataatttaatgttgactccctcccttctcctttccaggatgaattagtgtccaagtccaaaaaacgctactatgtgaattctctacagcacagagtgaaaaaccgagtgtggcagactctgctggtacttttccctagacttgaccaggtatcatatttttattatatttgtacctttgaagcatatgatttcatgactgaactattttgcagaaactatcatatactattttaaaattgaaaaagataatgtttaaaatttattctgcagttcttaaaattgaagttattcaaaagtttttattaacagagagaataccaaggcaattaggtattgtagaaataagttagaagtgggtttacatggccccatttaatatttttttcccttcggtgttttaatgtgacattttaactgtttaaagtctgatttgccatttgattagaaaatgcaaatacttaactcctaattttctgtagctacgttattttggagtgttacactgttttggattatctgtactgtagaaaccaggcaaattgtatcatttgggatgggaatattgtttcacatggtggatttccttgcccttaacttcatgaatagtgtgaccatacaaaccagctaaggaaaggccaggtatcttacaacaaagtatc

SEQ ID NO: 7071 - DNA, 1169 bp, Homo sapiens
tgctagaagacctttgatgtgctcttccttctgtctagaaagttctcgtgtcccttcatctttcctcttgagtcgtcacactcagcccaattgtcatttcttcagggaaacttcctcttactctctggatgagggcatgtcttcctagtgtagactccactagcaccatgtacttctcattcgtagccctcactataattgcatttttctatgtattctttgataatgcttttctcctgtactctaaattccatgagcacaggaaacactgggtctgcagcacccaggtaattgcatggcatgtagcaggcacacaaatttcttttttgttcctgttgaaatagatatgtataataatgagccatgctctagggtgttctgctgtagttcatctcggttgtatttctctcataatttaatattaataaggcataatcatttagtgggtttttttgaagcatcatccttgaaggattttgttaatgctttgcaaaccttaactgttgttatttaagcaggagaaaactgctttatgcctgattggtttgaagccaagcttgtttctctgatggtcttgctggctgtggatgtggaaggaatgaagactcagtataggtaattgtttctgtaattgaaaagaaagcctatttgaaaaatcctgatgagaattatgatgtgtattcagatttttgaatgattgaacttagttgaccacaaggtgtcaaggaaggtactagaacattaacagtatactgaagaaatgtttaaagttaataacaaataggaataggggcatattagtgcttttaaattggtaaattaaatgttaaacttaacaatttaatgttaattagatggccaggcacagtagctcatgcctgtaatcccagcactttgggaggccaaggcaggcagatcacctgaggtcaggagtttgaggccagactggccaacatggtgaaaccctgtctctactaaaaatacaaaaatcagccgggcgtggtggtgcacgtctgtagtctcaactactagagaggctaaggcgggaagatcacttgaactgggtggcggaggttgcagtgagccacgattgcaccattgcactccagcctggaccacaaagtgagacttcatctgaaaaacatttaatgttaaattagagaagatta

SEQ ID NO: 7072 - DNA, 1273 bp, Homo sapiens
tgggcagaccaacctccaatcaggaatcgatgaagctggtgtagatactacattaacttttaacgaaggcctcgtttctcctaaaaataagagaccaggtgggttctatctaggcagggttggtggcaggaacccaagggaagctgagctgcaccaagccgggctgggatccccctctctgcggccgcgcgcccggctccgtcggcgcacgcgcacgtaggggccggccggtcctgtgcgcacgcatcgcacacgccggcgccttcctttgggagcccgggccggtggcgcgggcgctcggcaaatggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggtacctgcctctttgccccccagcctagtgctacctac

SEQ ID NO: 7073 - DNA, 1068 bp, Homo sapiens
ctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatggg

SEQ ID NO: 7074 - DNA, 1089 bp, Homo sapiens
ctccgcctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcaggtag

SEQ ID NO: 7075 - DNA, 3266 bp, Homo sapiens
aatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttggcttggcgtatgtttggagaagtgaactctgctgaatttattgagtctaaagctgtgggttttttgttgttaacgtctttgaggatgtctagggccgcaggcttccctgccagaagaatgcacatttgcttcagattccaggtgaagaaaatccctgtggtagtgtcagcgcctgagggcttccaggtggtggtgggcccagcgtcaggagatagcagtcacctgggaggcccgttacaacaggttcgtgagaggagcccagtggtggtggtgctgacgtgcgaaacatgaaggcttgttagagaaaccagctgtgttaaggtgacagaatgtgtacgttagcactgtaaaaagcagctaattggtagcagaacgtgctagctgagaatacgttgtattctacatcactgataatgatctgaagtgtacaagtcatcagtatcagatctatgagagtttttgtagttttgctctaacataaatttctctttgccacctccaaagttattatattaatagtaaaagtaatgctttggagagggtg

SEQ ID NO: 7076 - DNA, 1025 bp, Homo sapiens
ggctatcctgtaacattcttttgaaatggaaccactacgcacaatggattgtggcaacctgaaaagaaagtacagtttaattcaaacaagtcacaggctgcctgtgttagacaagatgaagcattcgcagtctgggaccctgcatctctgtctgccacaaacaaggctgtcagctagtcttctgagtacgtgcacgccagtaacgcgtacgcctcgttacagcatggtcggcggatatgaaaaaaagtccgtggtcacgtgcaaattcccgactccagtgcgtacacccagcggcgcaggggaaacgccggcttcgcccactgcgcaggcgcaggagccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgtgagtgggtcctctctcccctggccaggcttgctgccttcggccgccgcccttcacaggaggggtcattgcctcccaccagcctgtgggccgcgcagggcgaccgcgtggtgcggccctcaataggcgatggcgctggctgcgccgctccgggggctctagtgccccgtaggaattccattttggaggaaggatttttcccgttttgttttccccagacactttagccgtgcaaatgcactcttgatttctgttgcaatctcgggtgtgtgtggcctggggaggaggttgtctctttttttgtcgttcatctttttaaacctctactcttaactaaaaagtcgtgcatttttgtcgca

SEQ ID NO: 7077 - DNA, 1135 bp, Homo sapiens
acagagcaaaactccgtctcaaaaaaaaaaaaaaaaagccacgtgtgggggcatgcgcctgtggtcccagttacttgggaggctgaggtgggaggattgcctgagcctgggaggttgaggctgcagtgagctgtgattacgctgctacactccagcctgggtgacagagcaagaccctgtctcaaagaaaaaaaaaaagagcttaactttttctaaatcttgagttaaatcattttttttctaaagatactagtcagtttctagatagcgctgctctaaaaattttgatatatttgtgagtagtaaatctaggaaaattcagaagacattgggaaatatttctagtcgggagggtagggctgtgctttgtcaaatactagacctaactggcatgactcttactgcttattttattttttgccttaaaaagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaaggtgagtttgtatatggtaaaagttcagagaagttaataactttgttcttcctgtgttgaataagcattcaatagtaagtcatggatataacttcattgtaaattattacataaatcatcctaatatgaatggattccagtatccaccccctccttttcattcctgtagtccctgccaattcaggcttttgcagattatatttgaatattgcagtgacctcctgcctggtttctttctttcagccttgtctcctgttatatgccactagaaagtaagctccatatgtttaaagatgtctttcctttttcttttctttttcaggacaggttctcactgtcacctaggctggagtgtagtggcatgatcattgctcactgcagcctcaaactcctggactcaagtgatcttactgcctcagcctcctgagtagctgggactacaggcgcacgccaccgtgcctggctaatttttgt

SEQ ID NO: 7078 - DNA, 1137 bp, Homo sapiens
acttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttgg

SEQ ID NO: 7079 - DNA, 1101 bp, Homo sapiens
tgagccgacatcacgccacttacacttttagcttggatgacaaagtgagactcaaaaaaaaaaaaagaagaatattaacttggaggtagcacaatctgggattatatcctgactccactattttctcagatatattatgataaaaatattatacttatataaacttggagaagcttttttcttttttatttcagctttattaaggtacagtttacataaaagtgatgacttttatgtttaaaatgtgatgggttttgacaaaagtatacagtgttacaaccatcaccgtgatcgtaatagaacatttccatcattggaagagcctcttagcctctttgaaacccagtttctttgcatgttacatagagataaaagccagcaacctcgggtggctgtatacacaggacctaatatatacagtccctggcacatagaagacattgctagtgttcttatcatactcatcatttttttttctgttattttctagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactct

SEQ ID NO: 7080 - DNA, 2168 bp, Homo sapiens
aataagatcagaaaatcattagtaggttcaaagcctttattattgctattatgtataagcctagaaatggtcacttcccaacaaaaaatacatcccttgttatacttaggacaagttgtaaaccccctttgttttgacagtagaattgttccagtgaatcatttatttccggtgaaccccagacacgataagcagtgtggtctttaaattttattagttggttgtcaccatcgcactaatagacaatctccattttccacagaataaaactgtaatgactttaggtcattttccagctcgatttctctgcccggcttctaaaattagaacgaaggtggggaaggatgtgattaagacagatccgataaagcatgctacacatactcttcccccaccccgtccccaggcagtagcttacccttaaaatcaaacaaacagacccatggtctccatttagaatcaaactgttgctatctagagacagtttaatgtcataatacgaggactaagcttgactttgactttgtattttgctgggcaacttactttgggactttcataggacaacagaaggtctgacacaggaactttgagaagacgtgacagcaatcccttcaccttttgaattgtcatggagcctatcaaaagacaagaaaagtccattcgttctctcaaatgacagttacctgtaaaactagctcatgtgatgagaccacagtatcattgcaatgatagctgtatctgtcttttttttttttttttttttgagactgacttacttacttacttaagtaagtcttgctctgtcgcccaggctggagtgcaatggtgtaatctcggctcactgcaacctccgcttcccgggttcaaacaattctcctgcctcagcctcctgagtagctggtgcccatcaccacacccagctaacttttgtatttttagtagagacggggtttcaccatgttggccaggctggtcttgaactcctgacctcgtgatccgcccgccctggccccccaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccatttcagtagtgtatttctttcttaatctgaataaaccagaatgatactctcagcacagaagaataaagggagcgagtcattaacgttttctttttaaacctttatgatgacttccttatgaattactgaacgaacactggaatgggactcaggtatcctgaggacatctctcaactctggccttagttccccctctgtaaaattagggtgccaactaaatgatctacaaggtcccttccagcgccgccattctgtaattacatcatgtgtaactgtattaaacatacacaagtgactgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagtgtattcaaacatatttttctatcaaaaatcatttttgtaaaagctgtgtgtttttatccaacttgtgataataaatgttctttattttagaataaaaactggcctttttgtatgtattgaatacagttaatagaatttataattttaattaacaatttgctctttcatgtgtgaatatgtgatagtctagtcctttcaaaagattgagacggactggctttcattgtttgaaggctggtgagagaaggggttacctgctgcacaccagtggggagtgacatactcctaacacatgccagaaacaaaaagtttggtcataaaacagttctaataagaaatctgcctggcctgctcacacctgtaaccccagcactttgggaggcagagggatcagagcccaggaatttgagaccagcctgggcaacatgaggataccccatctctacaaaaaataaaaaattagccaagcatagcgatgtacgcctctagtcc

SEQ ID NO: 7081 - DNA, 1142 bp, Homo sapiens
atgttatattattaccaataatgtgacatagtttttacatttctattgcatttctacttctagagaagcagttctctagacagcatagcattacatcttgaaactcttttgaaatgaagacatctctagtgacagaagcacctctcatttgttgggtgcttgatcagcttagacattatgagccattagttaggaggtggagtgctcaaagttaggtaggttttctatgagggaatgaaagagtgaaggtggagatgagaaatgcttctgagtgtttgggtcttagtgaggcaccaaggagaagactcccagacactcaaggaggctgaagtctcctgggtaagagtgggagggccagccatggagaatggcctcaaaggggtagtagagaaggagagaaaaaaaaacatccagcacttttctagcgttgcctggagcccacaatcatgaattctctggattcaccgtttctttcagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaaggtaagaatttaataactgcctaaaaagtcatgttgggtcatcagaaacaacaacaacaacaacaacaacttaggactgacattttaagaactattaagactaatcaaactacaggaaaaagaattctatttattccttgcccaaagtgctcctcaaaaaagctgtagtaagccaaatcatcttgctaatgtctcaaattttagcttcaaattaaatgtctaagtttataaaaatgcaattcactttttaaaaattaagatataattcacaaaccataaaatttacccttttaaagtttatgcagttcactttttaaagacattctacctaatacttatttcaaatccagtaagttacctttggagcctatgtacattattgcagtttattataaaggcaagtacattattgaggtttattataactagttaataaaagacgcacaccggcaacttcactgtggtagctttgtagttaataatcttctacatcagcattttaagtgaca

SEQ ID NO: 7082 - DNA, 1797 bp, Homo sapiens
gaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaatcttcctctatcttttctgaatgaagagatttaatgttgggaggctgattcat

SEQ ID NO: 7083 - DNA, 1118 bp, Homo sapiens
cactacttttgatacatagaaaatttattttaggctaggggcggtggctcacgcctgtaatcccagcactttgggaggccaaggcgggtggatcacgaggtcaggagtttgagaccagcctggccaacatgctgaaacctcatctctactaaaaatacaaaaattggccaggcgtggtggcacacacgtgtaatcccagctactggggaggctgaggcaggagaatcacttgaaccctggaggcagaggttgcagtgaaccgagattgcaccattgcactccagctctgggcgacagagcaagactccatctcggaaaaaaaaaaagaaaattttgttttaaaattgatctattcttaggtgacaatgctattttattatagtcagtaatgtttgaagagctttaaaaaaaagcctgcagtaaaaaaaaatttttgctgcagatattgatgaatgttcagaacaaccctcagtgtgtgggagccacacaatctgcaataatcacccaggaaccttccgctgcgagtgtgtggagggctaccagttttcagatgagggaacgtgtgtgggtaagttctccaggtaacttttcgaaacagtattcacatggtgtgcattagctcttatgcaaaagttctggtcccaggtaaaatgagtctggtcaagttggaaggtgctgggaagagcaatttataaagatgaatcagacttagcctctgccctccaactatctggagagtcacaagtgtaatgagtaagcaacattattgcctacactagtaataccatcgcctcacctgttgccagcttttgcattacatttgcctcttataaacttcttttaatcattttcattatgcttttaataactataagctattagacatgtttcttccagtaattagtagccttggggttcacattgagggagcaccttataggtacttttggatcattacctatcttagattgaattctactttagttacacctaaaattccaactggggtcattctatttatggattttaattttaccaaccacgagcagcagcataatttcttagccttatagaagtaagttgcggctattaattaggttaattatgctcttgctgaa

SEQ ID NO: 7084 - DNA, 1230 bp, Homo sapiens
gagctcccagccatcagtcaactcattagcctacaaaagacactcttatcacttcagaaattccaaaggctgtaggagctcttgtttcagaatgtgaggacagagaccaaacatgtattttcaattgtatcataccatgtcatggaaagagatagtggagagcatgaatgacttcagtcctaaagccactgtcagtcctatgagccaccttagctcataaggtagagcatgtaaccagcaattaggatgagcaagttgaattttaagtcctgatagtgtccctggagcacacttctggaatggctgggactgagcttgtgctagtattgtgcccatttggacacagtctcaccagacagccctagactgcctcagccacatgacgcccagacatgacggccagtgcccttccactctccagtcctagctgcaggtgatggcttgcagaccaacacagatcctcagggctccctctgcttgggtagtggtggctgttggtgggttgctggcctgtttctaagaagcctgtccttcctcctaggagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttggtaagaccatttaagttgcagttggtaacgatcttggatgtgtgggcttccagacaggcgtactgctggggagatgtcagttgtgagcattacatggtggtttgtaaagataagagcttgggaaagtagaggctgaactctcacagccgtggagccttggtgttatatgcccagtggcttcagagatgctcagtgatcttttgggattaggaccatggttttggagactgttgagtgtgtcttctttcaagtttcctagtattccgttctgtctgttttaaagagaaaacgtccgttagaattgtt

SEQ ID NO: 7085 - DNA, 1151 bp, Homo sapiens
ctgccatcgcctaatcttcagtgaattgggaaggcaaataaaaagagggaagcacctgaaattgcaaccatagcagagatccaccccaggattccaagttttgcttacctcagcatgggcatggtctgcaaacaggaagggtagttgctattgggattcccttcccttttcctcagcctgctgtgctcagccatactccactacccgatgactatcatgtttcccctttcagcctgtggctctgagacggtgaggccagcaggggtgagaggagccaaaagggctgacatagtgcctgccaagcctgtcttctctctgcttgtcctctcaggacccccatcctgttcctgggaaaggggagcttcttagaaagtgaaaggttatcttatgtaatcttttgtaagattaaagacttagcattaacaactttacaacttttttccctctgggatgaaatgataaaaaatatatgcttgcctttttactccttgttagtaacagtgaaagtctttagaaaactttttaagagagctctgaaaagagtccttgttttagggacagaagtactgaagaaaagctgggagaatacatgctttctcagtgatcggggagcagagaaatcctggtcagataggataaaagattgtcgctgagaaaaaagaagaaagctgcccaatgcgctgagccagcagatgtaaagaacgtaagctggaagcaagccaacaaacaagaaggacttcttgaagtcaaaagctgtcctttgggtcactcagattctgagctccacctcttccttaaaactgttcttttccagttaccccactgcatctcctattagttgctttcccctttaaacccatattctgctagagctgtcccaccctctcacctgccagaaatgacttagagctgagggagtcctcactaccgatatggtgaagacaagaccccctttctactacatagaggaacataattataatgaaaacgacttacgtgtattgagaattaactatatattagacactgttctaagcactttacagatgttaactcagtccccacaataggcccacgacgtagttactaatattactcccattctaagatgaggaaattgaggcatagaagttacttgtccaaagacacca

SEQ ID NO: 7086 - DNA, 1200 bp, Homo sapiens
tagtgagtgaagacccaggacacacccatttactgtactttgctttatcaaagagctgcatttaactcccttcaatttctctagtggtacaatttcaaattgaagtatattattttctgaatataataccatgacatgttttaaaatgtgacgttaattctaacgggaatatatgtgtgttgtaagagctcttagaatggaatttcagcctagtggaattcttgcttactacagagcttacgtggccttagccttagcatagttctaagtcccttttactccagatcagtgggtgctttgtataagtgaaacactggctagaacatgcacatcgcttagcatgactgtgtgactcaggacccccgagtctgatttccatttagacaatctcaagctgtgacaatgggaaaatggacaaacattttttgcagctttaatgatttggggattctggctgtccccttcaggttacccgtttcctaaaactggttccagaccttttggccattgtgcagcgtaagaaaaaggaaggggaagaagaacaagcaatcaacagacagacagcattgtataccttaaagcttttatgcaagaattttggtgcagaaaatccagatccttttgtcccagtgctgaacactgctgtgaaactgattgctccagagagaaaggaggagaagaatgtcctgggaagcgcgctgctgtgcatagcagaggtgacctccaccctggaggcgctggccatcccccagcttcccaggtatgcggccggagacttggaacaggagctgttaccgcctggcacacattgaaaaataacactttggtgactttttttttttttcctctgagtagacgttgcataaaattggaatttgttaaagaattgatcttgcagggtgtggtggctcacggctgtgatcccaccactttgggaggccaaggcagggagatcgtttgagcccaggagtttgaggctgcagtgagctatgactgcaccactgcactgtagcctgggcaacagagtgagaccctgtctcttaaagaaataataataaaaataattaatcttcaaacagaaagatgcagccttcccgtttatcttcagatgcactactttgcagtgttaatcgtcctccattcttccttccttttgtctagtatagtcaaaaagcagtgggtgaaggttcttggcagagg

SEQ ID NO: 7087 - DNA, 1099 bp, Homo sapiens
gaagcgtttgttttctggatgttactgttttttttttttccccttgttttctcttctgtcccgtcctcttccttagcagtttctagcatgttgatgtatatttttaagggaaagagaacataacagtcaggtgcttggtgcttgaaatgtttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaattatatgtacttaaagaattcagaaacttcttaggggtaagtaaaactgtaaaagaggggtgggatgaatttgcttacgaagaattgttaaataaactggccttttttgaaatttaggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagtagaactactggtgattttgagtaaatggtctaacctcattagtttttttttgagatagagtcttgctgggcactcaggctggagtgcaatattgaaatcttggctcactgcaacctctgcctcccaggttcaagtgattctcccacctcag

SEQ ID NO: 7088 - DNA, 1206 bp, Homo sapiens
acaggcataattaggctttggaagtcactgaaatatttctttccggttatctgccttctgggctttggtgggagcattttgggagttgctaggcaagtgaaatgagatcaacagcatgaggaaaacacgctgttttgcttctgaggtggtaggtaggccaagacgcagtggttggcttttttctctctccttaggttcgcccacagtggacagtttctttaattctaccttctggtcctcagggtgggccatggaagaccagttaacagctgacctcaggtgttctaaaagtacaggtcagacacccctagtacctcaggttcaggccgcagaactaggctcgtatttatatatcagcagttaatggatgcttattaagtctttactatctattgttctggtgccaatgtgaaaccgactgggtagaaaaggaagagctttttagaataaacattctcatgaataagagcatttgctttcttgcaaagcttacatactggccttcttggacatgttttcacagtagttgtagaaaagctaagagtgtctaactaatttttctttgttttttaacaggagaggagatacttacccttaagtcaagccagaaaaagtggtttccaaatggattggctgtctgaacctcacccaggtctgtttggctatggactagagaaagactgggtgtggtaactgacagtgtgctgaggaaatacatgcatttacttggctgcaaaatcaaaccagcagctaacgactctcaactgtgtctaatgctgatgagtgactgatgactggaaagaaagggaataggtaccatttatggagcaggtgttgtgtgccagataccatcctgagatggactcatagcagctctctgagtccttcagacaactccataatggacatgggaattatctgcattttaatttgaagaaactgagttttgggtggaaacttgaaaggttactaggaatctctctctggtctgtcttctaaagccatgctctttcctctgtgctgtgcttgcgtgggtccccgtctccttgaaggaagttctgtggaaacctgcctgggtggtactgtcacctgaggtggcctgggtctttcgcaggcccaggggcagatgtgaaatgtctaaaatgggaaacgcctttgcattcacacatctttaaaacactgcagcaaagcaggatcctctatttc

SEQ ID NO: 7089 - DNA, 1187 bp, Homo sapiens
tcttagagcctttatctctaccttatctctgttgtctctctttgcttgttgtgatgtgacattttcctcagtaccccaaaaaattaaaaacaaatttttatttcagagcccctcgttgtaatgctggtgtcatctatagattcttcatcttcctctgcatggaatgagggtagtagcctttgccctggggagagcctctcccttttcctgcagtgaacagtggaggaactagcagctgtatggtcccagctgctctttctggcccgtggagctttggattgacctttagggaaatcgttaattttaaggtctaaaatctttaggtcattaagtatggtccttcagagctcaggttgaggccaaaattgagctgcagagcagcagctgatgaaagtacaaaccaatcaagaatccagcctgtttcctcttgtcaaatttcccctggctgtggtccagatgagggagggtgtcctcatggttctaattcagggggtggaggctgcactgatgctgtgagcccctgcgtctgcctaagcatgcctgctgctttgggtcccaaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggtaggagccaggaggctgcgggttcctgtcttccttcttcagtagatactcttatcagcatactggcacttagggttaaacatgtttttaaaatggaagggcttctaatcacattgtcccttatgctgtcctttttcactcgtagctattctgcattttacttcagtattactgattagtattcttacatcattatttttagatgtatcaatttaaattatttcctcttggcctacgccagatgggagtttagcttatgtataccatcctgtgcctctcctgccccagtttcctgtcacaggcatggtgatgtctttaatccctcccttagagaccgacctttgtccctcagtaatgtcactttgcttcatgctcttgtctcattgcttgtggatggtgtccctgggtgctggtcttgcagagcgcccagcctt

SEQ ID NO: 7090 - DNA, 1389 bp, Homo sapiens
gagaatgcatacacaaaggtctgcctttatctcaccagttgtgtgaattatgtgtctgagcctgagaactcagtcctactgcgttgtgccctgggtgtgttctgaaagtttagccgctttcctaaagctctgagattggcactgatgcgcaatgacatggagctggtagaagacatcttcacatcctgcgaggatgtggtagtacagaaacagatggcattcatgctaggctggcatggggtgttcctggagctgagtgaagatgtcaaggagtatgagcacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgagtggctttgtgaatgcagcttttgtttaagacaagctgctaacgatgatggcaacaaatggctttacaagaacaaggaccacggaatgttgagtgcagctgcatctgttgggatgctgctgctgtgggatgtggatggtggcctcattcagattgagaagtaacctgtactcctttgaggactacattaagtcaggaattcttcttgcctgtggcatagtgaactctggggtctggaatgagtgtgtccctgctctgggactgctttcagactatgttctccacaacagcaacaccatgagacttggttccatctttgggctaggcttggcctacgctggctcaaatcatgaagatgtcctaacactgctgctgcctgtgatgggagattcaaagtccagcatggaggtggcaggtgtgacagctctagcctgtggaatgatagcagtggggtcctgcaatggagatgtaacttccactatccttcagaccatcagggagaagtactgagctcaaggactcttatgctcgttggcttcctcttggactgggtctcaatcacctggggaagggtgaggccatcgaggcaatcctggctgcactggaggttgcatcagagccattccgcagttttgccaacacactggtagatgtgtgtgcataggcaggctctgggaatgtgctgaaggtgcagcagctgctccacgtttgcagcgaacactttgactccaaagagaaggaggaagacaaaggcaagaaggaaaagaaggacaaggacaaaaaggaaacccctgctgacatgggagcacatcagggagtggctgttctggggattgcccttattgctgtgggggagattggtgcagagacggcactatgaacctttggccacttgctgagatatggggagcctgcactccggag

SEQ ID NO: 7091 - DNA, 1196 bp, Homo sapiens
catgagccaccacgcccggccaatgcccttctttctactcaaaacgttttttttttcttgaagggttcctggttgattgtgagttttaggaaaggaagacaccacttatatgtcagagtgccccatatgttggccagttgttatcagccatcttttttttttttttttttttttgagacagtgtctcactctgtttcccaggcgggagtgcagtgcagtggcctgtgatcatagattgctgcaacctcaaactccagggctcaagctgtccttccgcctcagcctcccaagtagctgggactacaggcgtgtgccaccgtgctcagctaatttttttaatttttaggagagatgcagtcttgctatgttgctcaggctggtcttgaactcctgatctcaagtgatcctcccacctcagcctcccaaagtgctgggattacaggtgtgaaccaccatgtctggccatcagccgtctttataaattgtggagaactgtcagttatcactttctgaaataccctaggtaaaatattaaagttctagtaaacatgatataagcggtatggcacatgctcataatgcatttgtcttgcccatatggatatcaaaaatattttatatattattattgaacactcattcagtgatcacttttaaaaagcagtgactacctttaaaattcgggattacctttaaaatgttttcagggaacatcctaaaaaccagtgttcctaggctggaaagaaggctatcttagaaataaactggtttatcactcagagctttcttccctgttctcagtggtctatttgtcctcaatggtatcatttgaaaatgagacagatgtggacttaagattctgtggtaagtcacgtgtgttaaccactttgaaatctcagggtgcaagccaggggacacatagaaatattaataccatctttctgtcaaggagtccttctggaagtatgacaacaaacagatataattttgcttaattttttgctatttgcatttttccttatttcataactaactgtgtctgtccttgtcgcccttcaggaagttgttgacatgaagtctgagggacaggccactgtaattcagcagctggaacagactattgaggatctgagaaccaaaatagctgaactagagaggcagtatcctgccctggacacagaggtggccagtggtca

SEQ ID NO: 7092 - DNA, 4562 bp, Homo sapiens
gactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaa

SEQ ID NO: 7093 - DNA, 1370 bp, Homo sapiens
tccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaatttcttgtgtgtattttttattgtgattatgtagtgtatagattctaaatatgtatcatacctggcatctttaatatcaattctattcggagtttatgaaattattagaatgccttaaatcactcgagtggaaaatgtgt

SEQ ID NO: 7094 - DNA, 1445 bp, Homo sapiens
ggaaagtgaaaatattgcacagttaaaaagggaacagtaaggcatactgtcctgtgctgggtcttatttgtacatcctgtttagaaatcggcacagtctgctaacagaatagagaacagcaaaaaggcacatagggaaaagttatggtgatactgagaaaagtaggggactacctgttttaatcccaacgagtgaacattagagatgaattgattcaattccttttctctttgtattctcctagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagtatgctttgcgtattgtgtttttgttctactaagagaggttagtaatagtatatagga

SEQ ID NO: 7095 - DNA, 1135 bp, Homo sapiens
gattcagcagtagaaaaaaccaaaagcatcccttaatggagcatatcatgtattagtgaaaacaaatcatatcaatagaaatatgtaatcgatgtagcatggcatatagtgctcagttctgaggagaaatagtaactcagagaaaggagctaggcaatggcaggcagtttggaggaggaggtaggggcctacaattgtatataatgtggccagggaggtttcactgaaaagtgacagttgagtaaagacctcagggagatgtgagaaagcaagcaaagtggctattacatgtaccaagtctcacaccaagcatagtataacattaatcatattaataaaacttaactataatagtaaattaaaaatttaaaaatgctgttaataaacttagctaaaggtgcacagttatgatggttttttttgtttgcagtatctaggctgtagaaagtgaaacagatattccaaggctgttctttcaaaacagtaatagtggaggcattaatgctccatgccatggtgaagtcttatgaaagtaattattctgattacagtaattgcttcctggggcctagaaaaaccaaggaaagcattagttctatgacaaggtactaaattaatttctgaaaaatatggttcacctgctttccatcaaccatttatttgtgtgttgtcagttgcttttttactttctttgagcatagaaaacaaaacatttacattcaaatgtctttttattcaaaagaaatgagaatggcgtactctaagatctcagtcttgtcatgactgatttgcaaaatcagggtttaaaacagcccttcagaactattctggcctctcaagtaactgagaaagactattgcttgggcaataaaatgggaacatgatgataaactaacccttatagctcagaattattgtttacataaagagtatttattctttttcattgctatatagtatccccttatatgaccatttcacacttttaaaaatccattcattctaccattgatgaaaatttgagttgtttccaatattgggatattacaaatactattaccctgagcattcttgtagatagatatcttttggtgtgcagtatactgatatggctttaaagatgttacttttatct

SEQ ID NO: 7096 - DNA, 3357 bp, Homo sapiens
aaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaat

SEQ ID NO: 7097 - DNA, 1986 bp, Homo sapiens
gtgtaagtaatttcttatgtgctttatgtacattaattgtattttgagttcctaagatttatcagtcttgaaaaagatcttgttcagggattgaagtgtttataagtgttaatagggtaaagtgtgaatcgtcttgcagtagtagccataatctaccttttgaaggcaaaataggttgaagattgctataagttaaatttttttaataaagtaatattatttaatatatacagttcttttactgctagctttaattgtgtaaactaacaaagtcatgatgtttcgttttgtaatgtgtattgataattatgggatattaaaactaaatctggtttggtagaaatcagaggtatgacaggtataaatttgtttccagcaaattactctgaattagattcattgtcatttcctaaaaacagtttgagtggcttattgatgttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacaca

SEQ ID NO: 7098 - DNA, 3357 bp, Homo sapiens
ataaatggcaaagttagtagctatatctaggaactttaaagaagctttactgaggtcagttttcaatatgagcaacaaaatacaccagtccctggattagtgtaaagacttcattcagcagttgaattgggaaaacacaggacatttttgaggaactcactaattcattttgactgaaaacagtgaacatgaaattgacctagaaaattcagtctagcttctaggtcagtattgtttctggttctggagatacgtgcttcatggtttacaaccatcagatttcttaactgtgtagcccttaaaggccacctaatagttctttaacctgtagcttccacaggataagctttgctcctaattttaattcttagttttttagaaagtttaaggaagcagattttaactgttgaatttttttctgtgtaacagaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagtaagggatttttttttttttaactgtggcatttgaatattgcttgcctggcacaaaatgacatttagaagaactagatgattagtctgtttcatttactttgtgctgtgcatattgctcttaagtaattgtttcccccttatgttgactgttaatctttccataaacaaatttttgtccgttagtgtaagggctatgaaaacttagatatttaaattggccttaacaatatttaaagaattattaggtggtgtctactgacagtgaaatgacatttcttttcttttcactaggttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacatggcgaagccccgttcctactaaaaatttaaaaattagctgggtgtggtagtgggttcctgtaatcccagctgctcgggaggttgaggcagggacaattacttgaacctgggaggcagaggttgcagtgagttgagatcgtgccattgtactccagtctgggcgacagagcaacactccgtctcagaaaaaaaaaaaaaagaaaagaaaaattatagaccgggaggtattctaggtaaactttttgtctttgtctctatccattttgttagtatcttaaagagatgggaggaaaggcaagattaagttggttctttcaactctgagggtaaactgccttccactggctaggcttctgtttttttccgtagtgtttttgagctcttaacatctagcagctaaaaagaattgagtaagtgtaaggtcttgttacatagtttaagtgaccctgtttttgtagcaataatggacaaaggtaatatttaaattataaaatgttgcctgctttacatatagatatgagttgaattttaaaaagcataacttattaaaattcacaagttcaaggggaaattttaacttttgaatataggtggcaggttttaagaagcaaatggcagatactggaaaactgaacacactgttgcagagagccccccagtgtcttgggaaatttattgagattgctgcccgaaagaagcgaaattttattctggatcaggtacgctgtagctttgaaattgaaaaatattaactgataatttagatagattggtgtagaattaatgtttagggttgtaaacataaatttctttttttaaagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcatggaattttaattctgttactgtgtgaaatcttctttttaaaagaatgtttttcctacatattctgcttgtgtaactatgttaaatctattaggacttaggcctcctgaaagttaacattttttccagcaatactgcttcaggaattaaaattgcagttgttacatatgcatatatgtttggtctgtttttatttttaggaaaatatgttactaaacctcaagaattgtcagctttaggattgtgaggattcgtggtgggtttctaaattaataatatgactttgtttcctgcaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggaggcaagttaattttgagtgttctgtatttagttcaggatcgaaacaagtgataattttatagtttggatgtagctgaagtttcttcctcattaatggtatactgtcacagtaactaaagtattcatgtgatttgatattaaatacacctaggttatgttaatggttagaattaaacatttcttttgtctttaaacaattatttttggagaaaaaggaacaatctagaggaatcctaagtcttctgtataagtagggtacaatatacaatgaaactaaaacagctcttgtcttttagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccaggtaatgattcaagatccctggaagcatgattgataactgtagcttagtctggaaaggtgtgagctttatgttggggt

SEQ ID NO: 7099 - DNA, 1465 bp, Homo sapiens
gaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggtgagtgctgcgttgtacgttgcgcgcggcgggaggcccgcgcggggtggggaccgtgccccaggcctgccggagccccgcagggggagggagccccgggcgggagggcgccgcggtgagggtgggggagggggcgcggggaatcccagattagccgagaggcctcgggctcggggcgtgtgtgtgcgcgcgcgcgtgtgtgtgtgtgtgtgtgtgtgtgtcggcggtggcagcgcctccattatgtggctcgagagccggggggagctgcagctgccgctgtagggggaggagccgcgggcgggcggcgggagggagcccggtcggcccgcggtggcgccgtcgcgctgcgtgcgcgcggtgcgggcacatgtctcggggggaggggagaggccccaggtcccggggcgggcgcgctttggcggctcctcgccgctgtattgtgcaaggagcgcaggggctcggcgtgacgtcacttccggcgggaggagccgggcggggcggggcggggggcggaagatcagtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcaggtataggatgctcacctagttttactcatcccttatt

SEQ ID NO: 7100 - DNA, 1185 bp, Homo sapiens
tgggtggaggtctgggtgaaccttgttacatttcaaattcaatgcctataaaataagaatttcaattttgaataagcagtgtgtggtctgtgctggtccacacacggttactggtctgtgataagtatagaaatggagaggaagcgtttagaaacatctgctgatggaataattttctgtctgttgaatctaagaataaaaaatcggggcttgcattttgtgtataactagaagtaaaagaaaaattggtccttcacccggatagtttgagatgcactgctatagagaacgatggagcatgaagcacctgttctgtgcttttcttcctctcacgattgtctttaaatggtcagcatcttagtagctgtctttgcttcagaatttcagtaccttccctttttttttcgagaaaagacactgtttctggaaaaaatagtaacagtcacccagaaaagagatcgagacaactgatcgtcaagttggttaactattatgtgctggctttgaacatcaagaacatttcaaacgagggccttttttttttttttgcatgattttcacattaatagaaaatggtgaagtagggtatcattagattttcccatttgctgacagttcactttgaataaaggtggacttaatgatgtactttaccttataaagtatggagtacatgaaacccaataaaaactcttgggtgaaaccctagctttgtaggttgaggcagtggaaccttcatgtatatttgaagagcagttagtggattctggattatgcatagaattgaaccctgaaacagaaaatgaatcttttgggtgacctcatatctttgcattgattttctttcccaaataaccattaaaactcatgggttttgtttttgttttttttgagatggagtctcgctctgtcgcccaggctggagtgcagtggtgcaatctcggctcactgcaagctccacctcccaggttcaagcgattttcctggctcagcctcccgagtagctgggactacaggcgtccaacaccacacccggctaatttttgtatttttagtagagacggggtttcaccgtgttggccaagatggtctcgatctcctgacctcatgatcctcccgcctccgcctctcaaagtgctgggattacaggcgtgagccatggcgcccagctgtgtttttttattc

SEQ ID NO: 7101 - DNA, 1179 bp, Homo sapiens
ggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttga

SEQ ID NO: 7102 - DNA, 1142 bp, Homo sapiens
gtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagt

SEQ ID NO: 7103 - DNA, 2399 bp, Homo sapiens
tatcagtagccaaatcaatcaagtggaagaaaggatatcagagattgaagatcgacttaatgaaataaagcaagaagacaaaattagagaaaaaagaatgaaaagaaatgaacaaagcctccaagaaatttgggactatgtgaaaagaccacatctacgtttgactggtgtacctgaaagtgacagggagaatggaaccaagctggaaatctctcttcaggatattatccaggagaacttccccaacctagcaagtcagttagctttaccgcataacaaactaccccagaacttagttgcttaaaataaccttttttttaaggttattgtaagtcagcagtttgagctggacagtccttctggtttggcctaggcatgctggtctcagtgggctcactcactctatgtggttgctggttggtaggtctgctgggaagtggaggtgactgggccatgtagctcatcagttcgcccagccttgttcacgtggctgtggagttctgggcactgtaaggaggcaagccccagtgtacaaatactttttcaactctgcttgtatcatattagtatcccatggaccacagccaatctcaaggccaccccagaatcaagggatgggtacaggctcctcattaggagggactgcagagcaccattgcaagggcgtggacacctggggaggaagaaactggagccatcactgcagtccaccatagttagccttacgttttttgtttttgtttttttgtttgtttgtttgtttgtttgtttgtttttgatgttacagaacatttagtgaatttgatgaatctaaagaccttctttctagaaaaccatacagttttcccttggtatccatgagggattggctccaggacatcctgggtaccaaaatccacaggtgctcaagttcccgacataaaatggcgtggtatttgcttataacccatgcgcatcctcgcgtaccttaaatcatctgtagattgcttgtaatacttactaaaatgtaaatgccatggaaatagttgctatactgcatttaaggaataatgacaaggaaaaagtttgtacctgttccatacaaatgcagtgtttttctgaatattttcaacccaatattagttgaatccacagatggcgggacctgcagatacagagggccaactgtacgtatgaacagtttgcttttaggatcagagattctgagactccctgtggcccatcagtggataccctggggcccttcatcagatgagaaatagacttgctacctttcaaaaacactggtgggaattgtacgggttcctcattttaaattcattaggaaaaaagtcataacagaaggtaggaatagtaacttacatgccagatgagcagcgttcactgaaagaaccttgtgtttgccaaattttctgaatgaaatttatcagtcagtgatgatcctggattaagagatttgccttcacgcctcctagagaaagcatgataggcttttaaatccctctcatcccgcttccagttttctaagagctaggggccctgcctgcatcaacttttaatagaaagcaaacatctaagcaaaggtaaacatttaccaaacaactttacagcaaaataattttggagaagggggcaagggatggagaacaaaatttaaaattcgtgtcaccagtggctggcgatttattgccaccccagcctccatgactgctatttcattaatccatagtcattgtagcggcaggcttttttcacgtcagtaacttgatgccattagttgctcctttgggatgagaacacatttaaactgaaaatgaacatgctggacataatttatagccatgccacatgaatgccaagagtgcaggggaggaaggctgcccgggaagcctgctcagaatggatgctcaggacatgcttgctgtagccaggcaggagcgctgggcaggcaggggggcagccggagcctgatgaagccagacagccacaaaccacagaggccccgagtcagccttcgctgcagggatgaaagagaaattccacacgtgggggcccgtccctgagttaggtcttgaaaatgcttttctgccccaattgggaattgatgttcgctcactcaagagtagcccactgggatcctgcagggagaagattctgggcgttgtctgtggagcatcgtgtaatccctatgacaggcaatcgttggcagaagcctcaggaagcccctggcgccctctctgtccctgaagtaagtaagagatcaaactggttgaggagaaggaccagaaacactacccccaaattgggacacccccttaacttctggaggtttgtaagcatctgaaagctattggctcaaagtcaacatattcaaaattgattcaaaacatgttaaaaac

SEQ ID NO: 7104 - DNA, 1228 bp, Homo sapiens
ttccttcttaaacattccatcagaatccatgaaataaaccgatggaaaaaaactgataaagatttttcctattttgaaaaaaccgttaatttgcttcatagtccaggaaaaaaccatgctggtttgattcagaagttaacagatcagatgtgtttgacctggtttttttgttggtggattatttcaactaaagttctcattatactttaaaatatttgttaaaacttgtatcccttcccaaattatacacatttaaaaatgtttaaaatttcaaaaattaaacgtaggactttctgtcttatatttttaccatccaatttatacataagtatatatagacaatgtactgttgctgcttaatgcaaaatagttgtccttaaagcaatttagcatttgtttacaaatatatatgtataattttgctcctgatttgaaactgcaattttatatatttagagggaaaaaagccaaatcatgctagagtgcactagatttcatgtaagagctgtttggagcagtggaagagtctcagaggactcagtgtgttttcatacttcgtgttctttcatgtaaacctgatttgagaaattcgtcatcactttttcctttacagaaactttataacaagtcagcatccatttgtagtctctggttcatctcaaatgtttagcctcttctcctttttttgttttttgatggcctttgtcatgtttcatcctaaatttatatctctaggcgcaactcctcttgtgaactccaattgttcattcttagtcttggcttggatttcaaatttaacttaaccaaaacagaactgttggacttgctctcaactccctgtaaccaaatttgttcctgttaaattcttcctcatcttaataaatggtagctatgatcttccacttgcttcggccaaaaactcgagcattatcctgactcctttcattccccacaagccgtcccgcagtaagtaaggcctgttggctgtgctacccagttctcctgctaccgacatccgagtcaccattgtctatcacctgggctatagcagtgacttcctaaccattttctccacttccattcacctttttatagcccattctctacacaacagccagaatgatccttttaaagcagaagtcagactccttcatgccttggctcaaaatccagtggctttctatcttcttcagagcaaaacccaaatatggcagtagggccgtaagtg

SEQ ID NO: 7105 - DNA, 1153 bp, Homo sapiens
ggccctaaattcagtgacgacgtctggtaatgattgagagtgactgctgactggaggtttgaaggacctggcttcccccactttttctttctttatcccttttgcagttttcataggattctctgtttgtgagaggattctgcagtaagcaggtacttgtgttttgcttttataacatcactgtaagcgtgcccctttacatgcttaaactatgcccatatgactctctgcagaaaactggacctgtttcctaggccctgctgtattccagctgagaggaggcataggacataccaagggagttttgatttgcttatcctcacatcctctaatttaatgggtagccctttatagagacaggtgactatccgcattttagatgagcaaaccaatgttcagggaagttgcccaaggtcagagagctagttaattgagaaaccaggattgaaaatcaaatccagttccaagtacagcgttggctccaccatatgtgatggtcttccagctgtaagcgtttgctttgctactgtgagaaacatttatacttgtctgctgagtcatagggcaatgggaatatttttggcttgctctatctggctaattaagcaatggcagtaagataggcagagcccacatttttgaggtttttctttgtaaccaacattcttcatgtaatgtttcccccttaaaatgttaaaattaggccagtcccagtggctcatgcatataataccagcactttgggaggccaagatgggcagatggcctgagcgcaggagtttgagaccagcatgggcaacatggagaaactccatctctagaaaaaaatacaaaaaaattagccaggcatggtggtgcacgcctgtagtcccagctactcgggaggccgaggtgggaggatcagctgagtccaaggaggttgaggctgcagcgagtcatgattgcaccactgctctccaacctgggtgacagagtgagacgctgtctcaaaaaaaaaattattatcccttattcttttatttcttatagtgtctgtagcatataggcctccccagggaacagtgctgtccattttctgggttgccctgcctcaacacaactctccagaccaccctctgtctggcctcaaccctacgtaaccctttgtgtgcac

SEQ ID NO: 7106 - DNA, 1180 bp, Homo sapiens
gcctggctttttctttttttcttttaccattttattggacttgatgtggatttccctaccacgcatttgatcctaaagaaactctatcagcacattttttccaggtgatatgtgtttgctgaaatagtcatatggtacctaccagtccttactcatatatctttttgcagttatttttacaagaatttaagcacttgagacatttcttttttgtgtgtgtgcgtgtgacggagtcttgctctgtcacccaggctggagtgcagtggtgccatctcgactcactgcaagctccgcctcctgggttcatgccgttctcctgcctcagcctcccgagtagctgggattatgggtgcctgccagcacgcctggctaatttttgtacttgtagagctggggtttcaccaggttggccaggctggtctcaaacccctgacctcatgatccgcccgcctcggcctcccaaagtgctgagattagaggcgtgagccaccatgcctggcctaaaacatttatttctaatgagaatgaatatgtgaataaaatcagcattctgttaggaatgaaaaggaatagatgtgtgtagtcagccagttagtgtacactaaaccagttggtattgtcagtagcagtaagagtgactgtctcctcagacttttgatgggctggcttagaaaagtaacatgaagataaagtgggtcctggatgtctttctttatgggagctgagtgattatgccagacatgagatctaggactcattttgcaaatgaagaaaaaacagctgaaaacttgtcaataaaaatgataaccaaaggagaaattatcatatgatccaatttagtaatgactgagggatcataaaaatttattaaaatgaataacagtttattgcttttctgctttttctatttttttccttttttatcttcagaaatcaagaaagacattttgctgctttgggaatgttatgccatttttgtcgttaaacggaatatttagagttaagatatgattaggataaggtaaaaccttatgaaatgttctcacatataaatgtatggaacttttcaattagctgtttaaaatgaaatatttatatatggagatcttctcagatatataatgtttaaaaaaaaaaacgcaacctttatttttattttttgagacagtctcgctctgtt

SEQ ID NO: 7107 - DNA, 1145 bp, Homo sapiens
atcactgattactcattttagaaccagtttccagcatatgttcttcctacttcctgcaacagtcattttgtagttactggcctggagggtaagtctttatccttccattagacgggttcagtatgagctgctattaattttaggacatgaaagagagataatcaacactgctatttctctgggaatacactgaaaattaaatatgtagactaaaaactacactgtatcttaagtcaacttctgttcattttaacagacatttagatgaattttggactctttcatttttaaaagattacagttataatgaacaataattaggaaagctttttttttttttttttttttgcaaaatggaaggaatttcaaaattcatagtaatggtgaaaagcaaagaaaaagaaataaccctaaacacaaaacaaaacaagaaacatgagagaggaccgaccatcagttagccatgatctgactcagtctgcaagacagggaataacttccaaatggttctttgttgctacacatttactgggtggcttaaaaaaaatactcatagagcaagagaaattatgtattaggataatgtcctagtaaaatattacttttgttttgtctttatatcacaaaatatttaaagtttagtacatattaggggctagagattgcagacacaacatgatgttctgtcttaaaagctgtattcatgttttctaatattcttagactgtatccttctcaaagcaagaaatgtgttttattcgtttttgtatccccactgtagcaacgtggaatgaacatgagattaaagaaagccatccttcatgtagtcatttttgtcaacactgagaaaatactgattgagcaggtggtgtaagccaggcacagtgcttagaggtgggggtaccagcttgtgtgatacgtgctccctgcccttctggatctcacagcctagcagggaagacagatgtgtacataactaaccccaaatacattcagagtgtctggaaacacacaggagggatggttgggttggagatgatttcacagaataaatcacattcaagtttggctggcctgtgacccataatttataaatcaaaatattggccatctagccaatgtcattatgagccacgcattatgcc

SEQ ID NO: 7108 - DNA, 1270 bp, Homo sapiens
tgcttttgggtccttatttgatatcttttccactcttcattcctatttgtttctcctttcttttcttttcttttttttttttttgagacagagtctcactctgttgcctaggctggagtgcagtggcacgatctctgctcaatgcaggctctgcctccgggttcacaccattctcctgcctcagcctcccgagtagctgggaatataggcgtgcgccaccgcaccaaagtgctgggattacaggcatgagccaccttgtttctcctttcttaaacgcagatcttttgactggagctgtggaactggggtcagagttgagctccatcagcacatcacctcgttatctagcacatcacacctactttgtatgtttgtgtagcagaccatttcttctttcgtgtttcctcattttacatttcatctcttcagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtaagtattcagagggatcattttgagagaagtgctgtggacattgacagtgccagactctcacaggtcaagttttcattgtctcttagttttggggctgatatgaaatgaacttgggtctttttctgagggctttcagaaagttagcaattaaacaagaattctaaattctgttttttgaattcacccaccgtgctgttctctggtttcagagtacttgtgcatggtaagggactgtgaggaaagactttgaaatgattaaaaaaaaaagagcatgttttgtctactcaaccatcaggtcagctctgcctttcactgtctttgagctgtactagaattgtgtgtgctgcagaaaatagacagtaaagcgcctggttcttgtccataaaatgcagttgtgtttggagaatgcaatagattattttcctatgcatattgactagttttgcacattttacatcttgctggcatttctgatgcttatgtatttgtgtcttctttgaattcttttaaaaatcagacttagcatcttactcattttctagtgagttaaatcttttatatgtgttttattaattttgagaatcattattttgctttacagaaaattatttcttaacaatacagtaaaaaaccacaat

SEQ ID NO: 7109 - DNA, 1140 bp, Homo sapiens
tcatcttggaaataaaactaaaaaaaaaaaaaaaaaaaaaggcagtagctgctgaattcttttaggaactctatggagttcaggttcttggtctatttagccgtagtggaatttatgaaaatctaaaacattaatgatgcctaagaggcaggctgcctcactgagatgaatgctttgcctggcctgatagcagaattaaagaaaattgaaacttcagcgttttgaagatcactggggtatcatttggtatgtattcagaatagttcatgaataatgtttagatggagtccatataaacccaattcatagtagagtggaaaaatttttatatacagaaaactgctgtagccagatagtaaaagaagatatatttaactgtttatagtaggcaacagaaggcagtgtggaagagtccaatgaaaacagtgttaggagtgcttcttgtccctttttacacaactagaaaatataaagcaaaagtaatttttataacatatgccaaggatctactcatatggtacatgttttatatctgccataacagactgacatagcatctttcactgtcaaattgagttagctgtggtacatatcatggatggtttcaaagctattttgccattaataaggcatttacaaatactataataagtgcttatagtatatactgccggtcctttcagattgctgctttgcatgcatcaaatcctatttataaagtggtattatccaaagtgaatagggaaaatgatctagaaagtcaggattttttttttccacactcacaagtagaatccttctctctagtgaattgagtcagcatttcagaatggaaaagtctgatgtgcaaatagctagccccaagatacctataaaatggggtcactcaaaaaggtgaaaagtacaatgaatttacatttaagtgtccttggcctcttttaggtgtgggaaatgagtgatgagtagctgactcaggaactatagctaacctcttttatatatagtctatgtttagagtatagtaaaaagagaagaaactgctttgtgacagtttcccatgtacaagagatattaatgaaataaaatgtttttttaactcatatatatatatgagtcccatgttaaaatatatatatacac

SEQ ID NO: 7110 - DNA, 1246 bp, Homo sapiens
atgaaaatctgaatggacctatacctagttaggagattgaatcagtaatcaataatctctcaacagagaaaagctgacttggagggcttcacaggtgaattctaccaaacatttatagagaagctgatactaatctttctcaaacttttccaaagtattgaagaggaagaaatacttcctaatgcttttattatgaggccaacattaccctgttaccaaagccagacaaagatattatgagaaaagaaaactacaaaccagtatcccttatgaacactgatgtaaaaattttcaacagaatactagcaaaccaaatttagcagcatattaaaaggattatacaccatgaccaaatggcatttattcccagactgcaagaatggttcaaaatgtgaaaatcaatcagtgtaatatatcatataaacagattgtagggggaaaaaaaccccacgtgatcatctgaatcgaagcagaaaaatcattttgacaaaattcaataccctttcatgacaaaaatcactgaacacataaggaataaaaagaaactacttcaacatagtaaaagccatatatgaaaaacccatagctaacatcttactggtgaaagaccaaaagcttttcctttaagattgaggatgagataaggatgcctgcttttcaccacttctattcaacatactactgaagttctagctagaccatttaggcaagaaaaagaaataaaaggcacacaaattggaaaggaagaggtaaaattatctctgttcatagatgatatgaccttgtagatagaaaatcctaaagatcccacaaaaaactatcaatgctaataactgaattaaacaaagtattggggcacaacgtgaatacacaaaaatccgttgcatttttatacacaaacaaacagtgaacaatctgaaaaggaaattacaaaaacaattccatccaaaagaataaaatacttaggaattaacaaggaggttaaaaacttaacaatgaaaagcagaaaaacattgctgaaagaaattaaaggcaacataaataagtggaaacatatcccatgtttgtgaactggaagatttaatattgttaagatgtcattacctacccaaaggcctctacagattcaatgcgttccctatcaaaatcgcaatgatgtttttttgcagaaaaggaaaaaaaaatctaaaatttatatggaatcttgagggactccaaatagctaaagttatcttgaaaaataaca

SEQ ID NO: 7111 - DNA, 1222 bp, Homo sapiens
tttaatattttgtggtatgttagaaataaagcaagagaaaatcgtgatactatattcaagattacatgcttgtgtttggccggtatgtgcctttacatttagagtgatcataaataatggatgtgatattctgctataacctccctcataattttagtgaagtatataaatcagcatggagggaaaattactaaatgacttttttgtgtatccttttcatcctctggtgaacagtgtacctcaataaaaagcgagaacaaagttgatcatgttatattcagcttttaagcttaaattttcagttctgttaaccatctcattctggatacactggtgctctgttacttcattgttgttggtgggctaatttgtgggaagagtattacctctgttgttttgaaaggtcaggagtgtgtatatgtttgtcacttgagggtttcaagttcatgtaggaccagattttagagccttttttgttgatgagctctgttgggtttcactgctgtagcctgctataaggtagtaaagaaagcaatcttttgaattaataaagtgatggattatctaattacaaagttgatgtgaaatggcagtatgataactttgactgcattactaaatgatcccagtgactgatcagatgtgcctgggttccattaaggaaaaatatgccattaaatatttaacactaaaagcgagcaggcacaccaggattgctaacctccagtcaccggggtgcttgtgtgtttacgtgtggtggtgactgctacatgccacatctctctactctgctcacaacagctgctagaatacttagctgttgggattatacttctcttctggtgttaagtaaagcaggcaaacagctaggatgcttaactgcatgcagatcctggcattctaattatgaaacggtgtcatgcatctatgatttatatatgttgtctttattacaacagattgaatctcgaagttgattcaggagacaattattctcagaaatatttctctaccttcaaataaagtgatgtttgtaggacacttgggctttcaaagaaaacaactcattgtttggatttttaatgatgatatttgtttatcgtgttcttcattcgtagccatttggttaaatatttcttttcacttatgtgttaataacctatgatgagttggtgtatatttatcatagttaaaaaccagatgccagctaaacttctgaagt

SEQ ID NO: 7112 - DNA, 2271 bp, Homo sapiens
cctcgcctacctgagtcgcgagctgtgtggggtgctggggaggggggggcgtcgggcggccggcagccgcgggactcctgctggatggggctgcacaggcagcttggcggtgctgcccctgacgcgcgtgtgcccgggggcgggtcgctgctgacaggccccgcccggacacccccctaggttgccgcagcggggctgggagggggcccaggctcagccactgccccccaacctgggctgcggtggaaatgggaaagccattgggcagacttgagggggaagcgttgtgccggggataattttgctgggagacgaaaagtctgtgtgctggacagtcttccttggtgcggctgtggaaatcacacgtggcgggcgtggggctgggtgggagctgggatgagtataaatcaggctcccctgcagaggccccgccggtaaagcatcaggcttgcagcaggtggaagaatcttgatgtctacggtgcacctctgtggtctgggttgtgtgtggcctggggatacgaagaggaacgggacctcctcaaagagctgatcaagtgagagagagaattacagtgtaccagaagggctgaaatagaggggcaattaatgtgctgtgggagcatcagacacgggtcccccgtgtgctgtgccatttaatggctgtgcaggcatgtctaactcttaaccaccattctagatgcagggattcacgtgaaggtgttttggaagcctggacgcgctgtgccggtgtaaagtgctatgtgaaagcaatttatggaaatgtgtaacatacatgaataataggaactgcattcagtcaacaaatattattgagcttctgtgtgcgaggaagaagagttctattttgagatgagtgcgatgattttgtgcatggccgcttttcagacctgccagtctgagatttaggtgggtggaggtgggacggtaagtgcaaaactcgtatctgtaatttgaccattgttcttactttgttctcatttgattcataattcaggaatatgactttgcattttagagctaccaaataataattttgtctgttgctttctgaagtaatgataacagcgaaaacatctgttcgggagagagcagcatcttgaagtttttgtaaactgtgtggttgaaaacaattcgttcctttcaagatagttcttggaacagaaaagttttggaatgaataaatggtgacaaattggcaattgaatcattagagctgaagttgagtcttgtgacacacggaattgtgcatttccaaaataagctacacaaaccctttgtgggtgggatgcttgttgatttaccatactatttcattagtctcattcatttttcctgtttgcagtaactggggatttaagcaaaaaaggaatttaatgaaagagttttgggggagttctcagtgttgctttaaagtctgccaagacttgactgggcatcggctgaaccaagttaggattgcactgcaaaagtagctggggctgggatctggggtgtatatcacttctgtcgcctgataatattggattctgcagtaggtaccacgaacaccatagacactggaccctggtgctgctgctgctgctgctccttgggaaactcactgttgctggagagtgattctctcaaccattcttctttgtgatactggcttttattcaaagtcctcagtgagtgtcttggattggctaaacttaggtcactgcctgcacccctagcgcgagggaggttgagacggtatttagcctttttggcttttaagatagaaggcaggctcactctacttcccaccgatagttatccagtggggaaatcagcaaacataaacatagaaaaagggatataagtaaatgctaagcatctaaacaaaacaagctaaacagattcttcataatgactgacaaatacttactagtattttacacagacacaaaatatttgcacttactttggattgccaggatacacagttcacttgtgttgtggtagtagttgctctgtttgaacactcccattttagtggttatagtgttccaaagagcctggttgggaatcactgcaacctgaaaatagtgttagggaaatgttagcgcattgtttgatgcagttttctgccactgttgaatgcctgtccttgagggataagtttctgtattacttgtcatcttgtaagtaaaatttgtttctctttattcactgtccattgtgaagtctttaagaatagtgcatctttcagtttttgtagccccag

SEQ ID NO: 7113 - DNA, 1213 bp, Homo sapiens
tctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagtta

SEQ ID NO: 7114 - DNA, 2063 bp, Homo sapiens
tcttacttgatcatatctttttttttcagaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaacattttaggatagcgcatgaatgatattctcggaccttgtagcaaccatgtatctgatgatcaaagcattggttaaactaaggtgcttagtatcatagtagtaaggtaaacaatgtactc

SEQ ID NO: 7115 - DNA, 1234 bp, Homo sapiens
tgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaaggtacttttctttctctgcaaaacagtttttcatctcagtcactcttcagcttaaaatttggttatttgtcctaaaaatggttttatagggaatttttccccttcccccctcaaaccaaaattgatcttttagtagtaaagtt

SEQ ID NO: 7116 - DNA, 1162 bp, Homo sapiens
tactctattcctgtctttccattccacaggcaccatccaagcacttttctttttctctctttaccttataactggataagtccttctcagctaaggttcatcataataaagccttaatgcccaaaagcatccgttttaggtagtgaattaacttctctagtactagctccgtaccgtccttgcgagagagactgttcattcaaatcattttgtactttctgcctctaatacctcaacgttgctcaagtattaactgaaaacaagcaaggatataacttctgatgagtgactactttttaataaggccttaaaattgagaaacagtcaaaatgcaagtgaatgaatctggtcttacatacaaatgatagaaatgcgttttgatgaatcaagtgaaatatgaattaaaccgcttaatttatgagaaaatcttgctataattctgttgaggtgattttactttgagattctttattctgtttttaaaaattatctttttcttccagctctatcgcctgacactagtgtttcagtctttacctggcaggtgaatatatatggacagggaaagccttctgtatatttggggctttttgatataaatcgttggtatcatgcacaaatgccagattcgttaaggtatgattctttttttttctctctcctttctctttgtatttgtatgtgtagctgaccaatgacttagtaatgttttaaattttcttttaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttggtatgtatttccttaacattacctcttaagaaaagtaatgcacaaaagtatgtaaatgtatacgttgtgtagtttattcatttagtgttatctgtttgtatctcactgttagttaacatatggataacttaggaaattaatatatacacacaagaaacttagtatttatatgttttataaaggaattatgacttggagatatttagtatttatatgttttataaaggaattatgacttattttgaacttgctag

SEQ ID NO: 7117 - DNA, 2152 bp, Homo sapiens
cttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggt

SEQ ID NO: 7118 - DNA, 2733 bp, Homo sapiens
gagaggaaggcctgagaggaaggctctggaaggtggggctcaggtcaggagcaggattgctggggaggaacaacgcagagcaagtggagcagggaagggtgttgtgggtctgtggtgggtgctgagagtggagcagggaaggctgttgtgggtctgtggtggatgctgagccagctgtccaggtattctgggagagcaggccctcagacctcagtgcagagtgctgaggaaggtggagacgtgccccatgggtcgccttgctctgctctgccctctgcaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaacagttaacatctactgtccttgctggaggaagagaaaaggggcaaagatgaggcaagggttgggcaagggaagagcagggttaggcggcaggctttttagatggtgtggtcagggaagggaggtgaaggaccagattgagtgagctgcgctatgcatgctcttgcgggggtggaaggccccatggccagggtggtcatgtacagggcaagtgtagagaagcaggggaggagttggtgcctcatggggccatgctgtgtgaggtgatgggtgccaggagagggtttggtagaaaggggcctgcggggtggagtgggctctgtctgagctaagagatgagagtgccagagggttgggatcttagatgtgtctggatgtgagcatgaatgtagagaagggacacaagtagtgatgccagatttatcaatacagtgaacccactgaaatttcagataggcagtatttttgtctgctgcagtgtttaggatgtacttacattatgaattatccgttgtttctctgaaattaaaacctaga

SEQ ID NO: 7119 - DNA, 1200 bp, Homo sapiens
cctgtccccaatctcattgcctgagaaatttgaggcacagaaggcaaggggtccaatccctacagtcaaccagagcacttggcacagcaggtaccaaggctggggagggccacagacactgggatggtgaggtgagggtagacagacaggggagaatgccgcccacagaagatgacagagaggaatcaagtgaaaagggaaaatgacccgggatgacagggaagctctaggctgagaagagcattcggcagggcatgtcagacattctggagtctgctgtggagaagatcaaagcagcccctggaagtttaactgtggaaaaatgggattctaaagaaggggacagcccatgcaatttagtgagccaggatgccaacttaggtcagtgaaaagagaaatactttgatatttaggagttaaggttgaagagcctgttacccttaatagtgttctaggttgagagtgtgtgtgtgtgtgtttccaaagcagatttagaagaaaatcatatatatacccatggtgaactattaaaaagcaagcagttggggagatactgttgtacgtgaatactgacatcaagtaggatgatcatacttacccaaactgctttcccctctgcagcagatagtgcattcatgattaggtgaaccaggggtgtcacccagagtgatactttgtacagggaacattgcaggacattgcagggtgagagtgtgacaaggaggtgagataatggaagtaaagcacagaattgggtgacaggagagttgagtggtcaggatgggatgggtgtggtactcatggtgtaggtgaggactgagcctcaaggaaacgagcaggccatgacagggagaactgctggggcacaggggccaggaaggggacagaggagcatgcctgccgggtcagctcagttcatctctccgtggaaggtggctatccttttgcctcttctctccctaccacccacttccttctctagcaccacaaaaagtaccagcacatccaccagaagtctttctcctgcccagagccagcctgtgggaagtctttcaactttaagaaacacctgaaggagcacatgaagctgcacagtggtgagtggtggaactccaccttcctctgtgggaccttttaccttcctttgtgggtcccgtcaccctgggctctgtgggtttcttcacctccccctctacgggg

SEQ ID NO: 7120 - DNA, 1404 bp, Homo sapiens
tatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactagctttagtaatttgtttatttagtgtagtcccctatacccaaccaaatactaccgtcgctaaatgttgatcacatactgtgggtcactctttagtgactgcttaactttatataaaatcagtgtgttaaacatcatttgttcacttaaacgtataaattgaatttactttcaccagatctcaaaaagaccatacatgatataataaggagaggatgattattatatcagctgcatatcaattattgcaaatcagcctgaaaaacagatacacaactcagaatggaatagattcttaattggaggccagctgaggctaaccctctgctgttttcatctacttcttggtatggtagttgtgggtagttgaccagccccaggtcttagtgccaacattaacccagccttagtcggtactctggttttcatcattcatgccatcattcatcattcatgtgatagacgtatcacaactgggatcagatggtttaggtctgaatattaaagtcccagttcctgtaggattgtaaagtttcc

SEQ ID NO: 7121 - DNA, 1450 bp, Homo sapiens
ctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaaagtggcacatttaaaaaaatgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatact

SEQ ID NO: 7122 - DNA, 1142 bp, Homo sapiens
actacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgt

SEQ ID NO: 7123 - DNA, 3605 bp, Homo sapiens
ccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaatttttcttttgattttttttaaattaaaatttcttcaataatgcatcttttctaaacatagttttttgtctgttcccataagtgcatgagaaagaa

SEQ ID NO: 7124 - DNA, 1099 bp, Homo sapiens
agtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggagg

SEQ ID NO: 7125 - DNA, 1201 bp, Homo sapiens
cacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaag

SEQ ID NO: 7126 - DNA, 1285 bp, Homo sapiens
gggtggctaatgagatttctgatgcctacgggggagggaagtgaggaagtctaacctgcagccctctttaaagaaacttataaaaatcagaaagggctttttccacaaagaaagacacttatcttctcaaaaatatttgcaaacattttcacaaccgtgctttagattgcgccgcagttcaaacgatctgggatgatgggcgtgagcgtcagtttgcggctttgttctgctgcttttctgttatgaacgttccctctaggtaattcagtctgttttgttgggcctcttggtaatgacgactaagtcagcttttctaaggaaaaagagttaaggtaatagatggtcaaagtgcagtgggcattttggaagcaacacatgagaaaatatttgaaaacggcacatgatcccctgcacagctccagcagcacagctccagcagcacagctccagcagcagtgcagtcagagcctctgggaaggagccactctgttcttaccctgcgaatggagcaggtgaagaatgtaactctagtagtttgtttcttataatactgttattaatgttagaagtggtgagagatttggaaaatgaaatttacgacaatactgttacttatgttagaaatggtgagaggcctggaaaatgaaatttactacaatacggttattaatgttagaaatggtgagagacttggaaagtgaaatttaccaccgcttattatggtgggaggttgtgtgtgtcctttaatttcactccctcctaaaatgttacaatgttatttaacatctgaatgacactttctgtaagcaaaagcatctcccatgttgtggaggcataattttcctggattgaataggatattagtgttcagaaagaaaagaggataatgatgggtttgaggttgaacaagtgcttttgcaattcctctgaccagttgcagtggaagttcttcctgttactggtgaaaatgttggcctcttcctcagccttttatatcactgtatccgaggagaataactcgagggtgcggacccaaatccatgtgacagtgggttgtgctttatggtcttaggaagaatgaatttagatgtgtttttcagggctatgccaaatcagtgtttgaaacaagttgtgtaatgccactgattttagttcttcacttagtttttttgttttattctgaaaagtctacattattctgatttacttaacagctggacagctgttttcttaccaaagaaaaatttaaaaagcaaactctgcagaaatcgttgtgttgaattag

SEQ ID NO: 7127 - DNA, 1148 bp, Homo sapiens
caaactgttggttaagtaagtggcttagtttgatgtgaaaggattgattgtgatttcatgttttattcatggaggtttaattgatagaaccccgggaacaatggtttaggctcctttgtcctctaatgcagtttcagtattccatgaaaacttaaactaacttagcctaaaaccaggttggatcagtgagatttgtgagaatgagaatgacccgtttgtggcagacatgcagggcttctcttgacttcttgtgaggattggtcttgtgtctgggtgggtctggttctaccattgagcagtgtgtgtgtgtgtgtgtgtgtgtgtgtgtgtgtgtattgtgtgtatgtgcatggggtctgtgtgatcttgtagctacgtgtgagtaacttggtctcttttgaataccgtaagcaggtggtacacgcagtgtgttcatgtagtcggccttgaaatgtgaataatatggaacctcctgcttcattatctgtcaactcaaaaacttacagtgtcactgtttcatgcacaacccacttttacctcttctttgcaggatcaatgtatgtgtcggccaaaaaatcatagccctcccccatgacaaccgacaagtgagactgtttgatatgtcaggagtgcgcctggcgcggcttccccggagcagccgacaggtaacagcacggtcggtgaacatatgcagggcacagtggaggaggacgggtagagatattttacattctcattttcttactaagtctttgcatgctaagttttccttggaaatgcttgagctgtatttagagttcataaaatttaaaattgaagaagtagagttgtacactcaagttattccacacctacttcagtgttttttttttttgagacagagttttgctcttgttgcccaggctggagtgcagtggcatgatctcacggcaacctctgtctcccaggttcaagcaattcttctgcctcagcctcagcctcaatctcccgagtagctgagattacaggcatgcgccaccacgcctggctaattttgttagtcaggctggttagttagtcaggctggtcttgaactcctgacctcaggtgatctgccctcctccgcctcccaaagtgctaggattacaggcgtgagccaccgtgcccag

SEQ ID NO: 7128 - DNA, 1191 bp, Homo sapiens
ccccggcgctcgcgcccactcacggtctccctcgcccccccgggagatgctcccggcgttctatcccgccccgccctggcgcgccccgcaaacgatgtgaccccggccccctgcggtctcccctcctccggacgctgcccctgccccacctgtggcgctcccgtcatctctagagcccccaaccagagtcctccagcccacccgcgaggctcgcgcacctgcgatgcggccccactagcagggacccgcccacctgtggcgctacccctgcctctgccgcctcccgcaccgctagcgcggcccccacctacgacgacccccgcgtagatgctcctgcccacacccgccccagccccggcccctgcccctagccgcgcccgcgccccctcccccgcagcccctcccatacgctcgggccccgcccgtcaccgcccattggcgctggggccgggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtgcgcgcccccctcccggcggcgagggagggacggacggacggagctggggagaaccgggcgaaggcgatggggtgaccggagagaagaggggggaagcgatgggggggacccggggaaaggtggcgaagcgatggggagaaccggggagaagagcggggaagcgatggggagaaccgggaagaagcccgcgcccggaagcggcaggggtacctgcggggcggcatgagccggcgaggcagccccggggtccttgcccggtggggcgggggaggaagggacatggcggtaggaacctccatccggaagatcagtgagttttccaccttcggttttgttttaaatggaacctggcagagggagtcgcctgaagcgccctcgggggtcgttctgcctctgagctgtaggacggggccgggcgtcccctccgaagcgtgggtacagcgcgatcacttcctaagtgcccccccgccccccaactccgccgcacgccaccccctagaatgtcgaggaagaaacggctg

SEQ ID NO: 7129 - DNA, 1142 bp, Homo sapiens
gtttatgaagaaagaaggaaatacagtcatccctcttagcctcagggactgtgtcccaagactgcagtgggtgtctgaacctggggatagtacccgccccctgtatacacgaggttgcttccatctgataaccaaggtggctactgagtgactcgggcaggaggcacagacagcatggagatgcagggcacagggatgattgacgttctgggtgggacagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagcccctgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtataggcacccaccaccacacccagctaatttttgtatttttagtagagatggggtttcaccacgttggccaggctggtctcaaactcctgacctcagatgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattttaagggaactgtcagctttcatga

SEQ ID NO: 7130 - DNA, 1183 bp, Homo sapiens
aggctaccttttccttgactgtctgaaaatttattttaatattttcttaatttcttttactcactttatttctttttttagtttttgttattttgagacagggtctgtctctggcactcgggctggagtgcagtggtgccattacaactagctgtagccgtgacctcctgggctcaagtgatcctccaatctcagcctcccaagtagctggggctacaggtgtgcaccaccatgcccagctaatttttaaaaattttttgttgagatgggagctcactacattgcccaggctggtctcagactcctggacccaagcaatcctcccacctcagcctccaaagtgctggcattataggcatgagccactctgcccagcctatttttattttttttaagcgtttattatttaaaacacttacacctgccctaacacttgttattagctgtgtgaattttataaactctgttacttcttatatatttcaagtgagttctggatttttctcttttctcttggaaacttgattttcagaaacctgtgcccagcagctctggtggagatgcccacgttccccatggctcccaggtcattaggaagctggtcatggtaagaaccacagcccatccgggttgccagcgggtgggtgcttccctgcatggctgtgtctgccactgatgttcgaatgttcctccgtccgcctgtctgtggggctggcgtgtccctagagttgcgagttcagtgcatcctttgtcactgccaccctgagccttttctctctcagacagtactgagtgaaggccctggtgggggtgtgtcctcctgtgccgaggagggccctggtatggggtgcgtcttccctgtgcccaggaagagggctactgctctgggtggtctcctcccgggcaactcacccttctttgaacgtagctcccgagctgagtcgatgccagtggagcggtctgacagatcctttccgcgactcagcctggtgctgatgctgtttggtttggttccttgtggagtagagtgatttaacacattcctatgatataatatgatatgaaatataaatatgtaactgtgatataaacggcgtagaatgaaatgtttttaattgaacagtatacgttaaggcatcacgtcaagattggaggacttcatgtcagttttacagtgagaaat

SEQ ID NO: 7131 - DNA, 1116 bp, Homo sapiens
aaaagaaaaacacccagcacaaagacagcttttccagggcctcagaatgtcatgctgttgtctcttacaggtcaggtcattaagtattagaattttttttttagatggagtctctccctgtcgcccaggctggagtgcagtgacgcgatctcggctcactgcaagctccacctcccgggttcacaccattctcctgcctcagcctccagagtagctgggactacaggaatttttaaaattttgtaaatctcagcagttctctgttttgatatttatcctgccataactcaaaagtttaaattttatttttaaaaaatgatgtaaaaatgacatggatgtacacagaaccagttacttgagaacactgctttaatgagcttttcagtggaggggctggagtttaaggcgcttcgttctgatctttaaatcaagcatattacgagggcatgatgaacgtgcccggattccagtgcatcatttctggttttgtcttctagatataatggctacacgagggaggcctactttagtgtcggcctccaagggattgcggagaaagacattgagaccgtcagaagcctcatagacagaacgattgatgaagtagttgagtgagtgtagcttgtttgtaacaatctgctttcgttcctcattcctgtgtgctttttgggagaagctgagcctgatccattgtttcggccttccttctctgtcatataacatgcttttgttcatatttagttgtttaaatattatctctgctaccttctgttactaaaactcttcaacatcttaggtttttgttttgttttgagacagggtctcgctttgtcacccagcctgctgtgcagtggcgtgatctcagctcactgcattttcctcccctaccaggctcaggtgatccttccacctcagcctcccaagtagctggaactagggtgcacaccaccatgcccagctaatttttgtgtagtagagatgggctttctctgtgttgcccaagctggtcttaaatgcctggcctcaagcagtcctcctgccttggcctcccaaagtgctgggattacaagcatgagccattgtgtctggcccatctttgttcttcattgtattctt

SEQ ID NO: 7132 - DNA, 1145 bp, Homo sapiens
ccagtccaagagctagtcctagaagacctgcaggatggagatgtgagaatgggaggctcctttcgaggagctttcagtaactcagagaaaggtaaaatgcaggccttcaataatttaaagaaatagaagctcagaactgaagtgaatttagttttgcctttaagaattctagagatgaaatggctccattgtcctatacttgttacatccattgagttgtccaggccttcccagctcgaacacccgcaggtgtatctaagaaataatgcataggcttaatgtattcacattgacataaataaattgccataaattgacagtcacgttaagattgtatgaccactttgtctagaataaacctttttttagcctgatttcttttttttttccaattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaat

SEQ ID NO: 7133 - DNA, 1256 bp, Homo sapiens
tgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccctgaaggtttcttgcctggtggctatgttgggggcatttggcaaaatatgctggtgtggcaaaggaggtagtggtaagcctcataaaagttagtaaaaattgtagttcaacctttgaaatcattgatgaatcagcg

SEQ ID NO: 7134 - DNA, 1708 bp, Homo sapiens
gattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactactgcccggtgttggtttgtgtgtcctgattgcaagggtcacagctgccgtgcttcctttggtagcactggagtcaatgccagtcagaatgctcagcagcggaaagcgtgggtgtcttctgatctggaaggatcacagcaggtcctgtcgtctggcttccctgtgagtagacctcgagttttattcttgacacagtaccattactagacctatcatctttgtgcagaaaaaatagtgtttaatgattttgcttgtagcagcagttataagggagtaagtgaactgtcaggtagagtaggtgctttagtaaataatttttgtgtagttgaaatgataaagtgtttacatataaggccctttcccctgacagtgatgagcctcacggcagatgctgttgtttaccacagataaacactgactcttcagagtatgaaggagacagactaaggtagatgatgtgttaaaggaactagggtggtgattta

SEQ ID NO: 7135 - DNA, 1122 bp, Homo sapiens
tttcttttttttttttttttgaggcagagtcttgctctgtcacccaggctggcgtgcagtgctcactgcaaccgccacctcctgggttcaagcgattttcctgcctcagcctcccgagtagctgggattacaggcatgcaccaccacgcccggctaattttttaatttttattagagatggggtttcaccatgttggtcaggctagtctcacactcttgacctcatgatctgcctacctcagcctcccagagtgctgggattacaggcatgagccaccacgcccagcctagataaatttcttaaatcctctctaactggttttgttatctttaaaactattttcaacccaatcaggttagaaacaaaaatattttgatctagtataggtgaagttgtgaagatggattacggaagatattgaaagaattgatatttttattgggcactatcaactcatgaggtcagtattgctccagggattgtgttttaagtccatgtgatttttgtcacccctcagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgtttccaagaggaggcaataaagtgcatggtaattcatatcctgcttcttaagtcagtcacagattcagcgaaaccagttggaagccagttttccatctcctccacttcctcccttccctcatcctgcatgttccactcctgctgaggagttcccagtgatcagggggctgagttcccagctccatgacaggcacattatggagtcccaagcacagtcataatcttcccgtagtccatatttcactctttgtactcttaaagtagaatagataacgtttgcgcgatcaggctgtgggatccttagagaagcatgtaccatgcatgaatataatatagcatacacactttcacaaacatatgaaatatcttatagtaactgctgcatggtaaggctgtgataataataacaaaaatatcacatacgttgctattagcttgagc

SEQ ID NO: 7136 - DNA, 1195 bp, Homo sapiens
aattgaaactagtctctgggagtggggctcaggcatctggatggtcttaaagcgtcctactgactttcatctaactagggttgaagccaccgctccagtgcgtagcccctaacctcggacacctttgtgggccatgagctgatgagatagtgaggtcggggtctagacaggtgcacccaagttactgcaggagtcaaaagatggccagattgtatctccttagaacatacagaacatctttccggcaagaatattcattcaagaagattttaaagggtgaataacatttcagtaagatataaaaaagacgtttgaggagatagaaatagcaaaaggaaagttagaatcaggaaagtagcgtcctccctctgtggttttaaaaaaagtcgtataaaggctgtaaaattgatttggtgtttttctctccttgtggtaaaccaaaaagtaggttaaatttgttcaagataaataattgatacaagtgaggtttcagagtgttttctatagtattttggtgagcctactttatttttctccaatagtaccccgagattttccttatgaagaggactcaagacctcgatcacagtcttccaaagcagccattcctcccccagtgtacgaggaacaagacagaccgagatctccaaccggacctagcaactccttcctcgctaacatggggtaatgatttaatgttcttatctaaggacttgagagacagtgtgaagcgttgatagccctttcaatagatgcagcttgtttgaaactgaggacattcaggacccttggtgtgtgcaggtcacacggtacctgcctcaatcgtgtggagcgtgttccagtgtaatgatggggcttgttcaaaacagcaacctcccagtagaagttttgactcattttgatgttgaacattattttcctagacaggcacagaacctgattaatgtttacatttgccttcataacgtttgcaaataaaatagctcatatgaatcagagctgacttactgtctccaaagggcaggtgataccttttttttcctgataaagtgggccatttgctttcaggtcatggttctaaacctttggtctaaaaaactcggggtcattctaactacaagttgacatgtttgccagcatataaaatttgactgtaaggctgacgctcaggtggggcttggggatttttttaaac

SEQ ID NO: 7137 - DNA, 1461 bp, Homo sapiens
agaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcag

SEQ ID NO: 7138 - DNA, 1202 bp, Homo sapiens
atcgagaccatcctggctaacatggtgaaaccctgtctctactaaaaatacaaaaaattagccaggcatgatggcaggtgcctgtagtcccagctactcaggaggctgagttaggagaatggcgtgaacccgggaggcggaactggcagtgagccgagatcacgccactgcactccagtctgggcatcagagccagactctgtctcaaaaacaaaaaaaaaaaagaaggaagggtgcatatggaactggaaagagaatgaattcatactctcactcgtttaacaaatagtattaggcacctactatgtgctaggcatagttctaatttctgggaaacaaaaatgaagaccacctggttctttcttcatgaacagtgggaaggacaaacacatacgtgagcctgtcttgtcgatgtaagatgcgtgtgcgtgcatttctttctctttcttcatctgcccagctttgtcctgctgcgtcagcactggctcagtgttggtctcgtttctcttgcagacatcattcagtcgaggtttcacaaagaacatgaaacttgaagctgtgaaccccaggaatccaggagaactgtgtgtggcctccgttgtgagtgtgaaggggcggctaatgtggcttcacctggaaggtacgtactcgctgggggtagcagtcgctggggggaatgtagagtttgtcgaaatggcaacgtgtggaggaaagcagcccttctcagaaggggccttacttctctttcatttaaacagatcttaaattattccgtgttcttaaatcagtgaaactaatcaaacataaatgtagtcagaggctctcatcttaactaataatttcatgcaatgagatgctggcaagataattatgtttggaacacagtggtctttttacatctatgattagaaaagcaaatgtcacaattaaattaatgtgagtcactaaaactgagattccaggtctcggttattatcaggacaaaattgtacatttgtattttaatgtggttatatcctttactttgatttctttcgtagttgtttaattcttcctcaaaatagtacctggaggatgactttctccccaaatgtctaataaacagaatttaggcttgtttgttcagtgatgttgaaactatcctttatagctatagcgtatttacaggtgcaagaaaattcacagaatgctgtattttgtga

SEQ ID NO: 7139 - DNA, 1184 bp, Homo sapiens
cacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagtttaaaataaggagttttgcttctgtttaaacagcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcaggtaagggccaaagcttttgctgctgtaaagtattttagaaaaagatgtgatattttcctggatgtgtttctagaaaatgtatgagctttctggtatcttttatatctgagtatgtgaatattaagcactttaacttcacaatgctttccatagagactaaaacctaagacctcaatcaatagtgttctcaaaggagaaagcaatgttagaggccttagggaaattgatctagttccttgggaatcactggttcagaaaggaaagacacagtagattgagacttgaggatattctccacgtttttctttaggaattttgatagtcttgtaagtaggttccgaaatctctggccatctgtgtacccatctctcagtctgtccattcaccaatccatccacctactcatccacccatctatccatttatctatt

SEQ ID NO: 7140 - DNA, 1225 bp, Homo sapiens
caaccatccgtttttctttttttgaatatttctcacccacggttggttgaattcacatacagtatctaaatttcattaaatataaatatggaaaatcccatttgctgcatgaatttgtgtatttgaatgtgttttagtgtatttggtgttttgttttgttttgtttttgagactgagtctcgctctgttgccaggctgaagtgcagtggtaggatcttggctcactgcaacctctgcctcctgggttcaagtgattctcctgcctcagcctcctgagtagctgggattacaggtgtgcaccaccacgcccagctaatttttgtatttttagtagagatgggattcaccatgttggccaggctggtcttgagctcctgacctcaagtgatccacctgtgttggcctcctaaagtgctgagattacaggtgtaagccactgcgctcggcctgatttgtgtgtgtttgaatgaataaatatgcagaggtgaaacacattcatatttatgttttgctttgattgtatgctaatttatggcagtggctgtttttttaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggtgggtaagcaacatcatcctgagaagcaacgtccagaggtctaaagaagcacaatggcttggtttttcttttttgtttttgttgttgttgttgttttggagatggagtcttgctctgccgcccaggctggagtgcagtagcgcaatctcagctcactgcaacctctgccacccaggttcaagcagttctcctgcctcagcctcctgagtacctggaactacaggcgcccgccaccacgcccagataatttttgtattgttagtagagacagggtttcaccatgttggtcaggccggtctccaactcctgacctcgtgatccggccgcctcggcctcccaaagttacaggattacaggcgtgagccaccgtgcccagccagcttgtgtcttttcagcgttgaatcaagttctgtgggcactgttcctgaactaagaggagaaccagcctggtgtcaaaagcacatttttggcattgacaaaccttggtt

SEQ ID NO: 7141 - DNA, 1108 bp, Homo sapiens
ctaatttttgtatttttagtagagacggggtttcaccatggtgtccaggctgatcgcaaactcctgacctcaggtgatccacccatcttggcttcccaaagtgctgggattacaggcatgagccactgtgcccagcctatatttctaataaaattgttttcactatctttttattcatagttctatgcattcttcattaaatggcttaacaatataaaggttccattggagccagatgttaactggtactagctattcttcctgatatactgagggttaaagtaaaaaatatttctcagatttaatggcattattacattttaacacttctctagtgtacagtcctaattatgtctgacatacacaattgggaatagttagaaggaaatcattctggaccaatcagtaatggaatgaaaaactcaggaagtcccaatgccatggtaaaggagaaaaactcctttttcatttcctttcatgtacagtgtgttcagattaactttaaaggagagtgagatgtaggtcttaagattttgtctgcaattgagtattacctgtatatggagcccatctcagcaggcacccagtcatcagccagcaaccccttccaggtccctcgacctggtccctcgacagctgctagatatcctgttgcaaattaaatatgaagcagggatggacttaattttgcatttaaaggatttcttaaagttcagcctcaaatgaagttgttagtgttttcatttttattgaagctggctttgttggaaaggaaggggcagctagaattgtcctcagtggtattaaagaaaaatgctctggaaaaaataaagtttatgcctaaagtttggcataaactttatgccaatatgcctttatatatctatatgccacatttcataactcttcttataaatactgcacagttgtcaggcctgccaaaatggtatgtagcctactgtgtcagtacagcctgttagtaaacatatgtttatagtttaactgtttcccagtagggtgtttttgagactttcctttttcagctttgtctttctgaatggtagtaacaaagggaaataaaacatggtgagtttatatcacactttga

SEQ ID NO: 7142 - DNA, 1192 bp, Homo sapiens
ggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttg

SEQ ID NO: 7143 - DNA, 1744 bp, Homo sapiens
tactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttcctt

SEQ ID NO: 7144 - DNA, 1126 bp, Homo sapiens
agggaaaggagcctccgaaggactcgcaggggcagtcgcagctgatgtttgagtgccctgggatgggagtcagactggctgaggtttcaattttgcattcatggccagccaccgttccaggtcctgttgagatcatcatgtaacaggacaacaaagtccctgtcctcatggggcttatattctgatccatttcctcatctatgaaatgaagattgtagtttttatttcatagagtcatgaagattgagttaatctctgaaatatccacacagtgttgtcactcaggaatgatttggaatgttagggatagtcacccaccaccacagtgctaggtttcagtgaccaggagcgatgtggagctgagtctagtgggagtccagaggtaaagacacagtaaggtcacatgtgacccaggagggaggaggcacaggcagggcaatctgaggagactgtgccatggctggaggagcaggggctccaggaaggaggcagcatctgcactggaaatgcagcaggagggcccagtgagggaggcctggaaagtccacttggacttgacaatgaggagctctctgctgtcacctgctgtgattcctagagtcagaatcagactgcagtggccacaggcacaagtgggaagtgatgcagctcaaaggtttggatgagatgggatgtgcagcgattgagtcgtagctggagcgaaggatgtgctaagttagggattggaggggcgtgcatttacatgggaaagtaatgctaattagaaatcagttggacttcaacattctcaagtacttccacaaagcatcccttggttttattccagtttgttgctttacgtatttgtaagtattaaacaccaattactaaattatctgtaattcagatttgtcatttggaggaaaatcaacataatctgaatataaagcaggcagcattgagaaacttctacgtatgtgaacatcattgacttcgtcgagcagtgatttaaagtctgctccacatgtagtaaacaaagaggagatgtgatttagaaatagcatatgtggggccaagcacagcggctcatgcctgtaatcccagaactttgggaggctgaggctggtggaccacctcaggccaggag

SEQ ID NO: 7145 - DNA, 1253 bp, Homo sapiens
actgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctc

SEQ ID NO: 7146 - DNA, 1124 bp, Homo sapiens
attgtttgggtttttttcccccgaatatttttggtccatggatgtggaacccgcagatgccagggccacctgtaacttgggggagtgacttggtggtggtgggtagcgttgcagacgccatcttgctggactttgtcctgtggcagtaagctctctgatgtgaccctgtttgttcctttaggagacgttgatccagcagcacgtgtcatttcattaggtcctgtatctgatgttgtggttagtggagtcctccagcaattgaatgagagcagtggacacatctcagcaggtcggtctagagagttgcgaatctaaacctgggacaggctggggccaggaggcagaaacaccagcctctgccaacaccggaacaagccgacgcttccagacaaggcggaaaaggccttttgtaatggaaatctcgcgagggttaatcttctcttgagaatggcagtcaagaaatgagatggttcacttgactactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtt

SEQ ID NO: 7147 - DNA, 1201 bp, Homo sapiens
taatttttagattttcagtagagacggggtttcaccatgttggccaagtctcaaactcctggcctcaagtgatccacctgccttggcctcccgaagtgctgggattacagacgtgaaccaccatgcctggcctggtcttacttcttaagaactaaagatacttaagttcagaacttaatctgagatgatcaaaagatgacatgtggaagacaggctcagtacaaatgaatggaactgaacctctgctggggctgtgaccaggactctggaatgtcaagatggcaagaagccccttcctaatagtttgggtagttggatagtttgcagccttgattcataccgtagagccccgtgtgaaaactggggtactgggaagaggcagcagaaatctaaggcctggattccagtccagaagaacacacattctaagggggtttccttggggtgagttattctgccgctcaggttattctcctcagcccctcctactgtcccggatcctaggaaaaccatcccgctgtgtccgtgttatgtctctctccgggatatgtagtaaagtggcattgctgtggccacttggggagtgtggggccatctcacaacacacacagacttatctgccttccactggagaagctggctgtctcctggcagctcacgtctgacatgatgttctgcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagaggtaaggttactcgctgtgtttctcagtagcactatatgattgattgtaacagaataaaactgctggtttcattctggtgataaatgatggtgatggtgatggccgggcactgtggctcacacctgcaatcccagcctgttgggaggatgaggcaggaggatggcttgaatctaggagtttgagaccaccctgtggaacaaagtgagactttgtctctaccaaaaataaaataagttagccaagcatggtggcacgcacccgtgttcccagctactcaggagactgaggccagaggatcacttgagcccaggagtttgaggctgcag

SEQ ID NO: 7148 - DNA, 1244 bp, Homo sapiens
ggtatttggattggttttccatgtatacttacttatttatttattgagacctaatctcgctctgtcacccaggctggagtgcagtggcgtgatctcggctcactgcaacctccgcctcccaggttcaagtgattcttatgcctcagcctctctactagctgggattacaggtacctgccaccacacccaactaattttttgtatttttaatagagacggggtttcaccatgttggccaggctggtcccgaactcctgacctcaagtgatcttcccgtctcagcctcccaaagtgctggaattacaggcataagccaccactcctggctttaaattttcttttttgttgtatgatttcaactcagcacttcttccctagactccattgtgatgaatgccatttttttccttttgaatgtatccacaatagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtacttggagcttctgaaattgaggccagaggtggggaaaactgggaagaatgtgtgggttgggagggctgaaagcacatggcagacattcatgatgaaactgagatgaccttttggaaaaagattctgggattgttttaaaaactaacaggagattcatgaggtttagtcttcaggcaactggctttagcctggggcttccacttctgttttccttgcatggcttatgaattaacttggggtttgggctggcaaacctgctccttcttagagcacagatgtcattatctctctggaagtatggccttcttggaaactttgtggttcccatacatataacaagacaagcgtgaaaaaaaaaaagactttaagtgtggttttacttcgtttcttgtttactttattatcttttcttttttatggctttttttttgagaccgagtctcactctgtcactcaggctggagtgcagtggcgaaatctcagctcactgcaacctctgcctcctgggttcaagtgattctcctgcctcagcctcccgagta

SEQ ID NO: 7149 - DNA, 1239 bp, Homo sapiens
gtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgttttctaagatcatttgtataggttcagtgtattcataagaagtccaccctgagatgcctgtaaaagtcaaatgtaattacacttcaaactttaatcctaaattattgacagatagatagatagtgaccaacttaagggtaatcatatatgtgactaacatttgggaggaaacaggaaaacagtggtctcaaaacaacaatatcccagtctccatttgaaagagcatagatcttggtaaatcattttgaaaactatgtgctttatttcccaaaagatcaaacttaatttttaaaagacacccttttcagaagtatgggttttcattgctgtttagtttcttaggtgtggtatgtcttacgtagcttatgcttacaaagccaaataatcgcagggcaaggcagataaaggcaggcaggatagtgacagtggctcggtgagcatccgccaagggcctcagaccactgttaccataaaaacatccacccagtgttatgacgtccgatttttttttcccttaagaaggtggaaatatg

SEQ ID NO: 7150 - DNA, 1152 bp, Homo sapiens
ctgagactgcaacagggaaagcaagccgaccacatggggctaatattgacagttcccataatagatggaccggagcgagcatactttgtttgactttgcctcagttgttttctttttccgagccgaattaacagcacacacctggaggaacacagtggggatggtgttgtctttccctcacgagcaggagaggtttggattgactgcccaggccagctcagaagaggaaattctgaaaggggatccgtctttgtcatattccctgaatcaagtgtttctggctgcagctgcctagccaggtgttttgctggctttattgcctggccttttatttttctgcctcttgaccaacaagaggccttcctgaatgtgctccacaagatgtgtcaggatggggagtgaggacacagccaccctggacgcgggcagccctggggaaggcatgatgacaggcttttgagttctttggacaggccataaatgaatcgtgtgggtctttggggagcaaagcaacactgttgtaaatctgtgggctttgtcagcctttcagtgctgaacctgtagttggtcaagtcatacaatgtgcagtgggcctataaagtaaggcctgttatgaatatgtgagcttcttgagggcagagcctttgactttataaaaagtacttaattaggccgggcgtggtgattcatgcctgtaatcccagcactttggaggccgaggcagtcagattgcttgagtccaggagttcgagaccagcctgggcaacatggtgaaactacgtctctacaaaaatccaaaaaaagaaaaattaaaaaatgagccaggtgtggtggcatgcatctgtagccccagctactcgggaggctgaggtgggaggatcacttgagcccgggaggtggaggcttcagtgggccgtgatcatgccactatactccattctgggtgacagagggagcccctgtctaaaacaaaagcgaaatcaaaaacgatgtgatcagtgtttgctgaactgatggtgcattatccagtgtttagagtgaattcaaaactcaaaagtagggaaagtgcaagtgatggatgtggctgtatctctacattcatctgtgttcacttcaaacatttatgcctctctgttcgcttgactgcagcgg

SEQ ID NO: 7151 - DNA, 1353 bp, Homo sapiens
gctgggcatggtggtgcgtgcctgtaatcccagctactcgggaggctgaggcaggagaatcgcttgaacccgggaggcagaggttgcagtgagccgagatcgtgccactgcactccagcctgggtgacagagcaagactccgtctcaaaaaagatggccatgctggccaaggctgggctcataggaaatatctgtagtaggatgaaaggaatctggcctagggagccccggactcggtttacctaccccgtactcatcccactcatctgtctaccctagtgtccatcatgccctggatgaatcgtaggtgggagggacagaagccgagaacaccaggcacacggggtggggggaatggggggagcccaggtgatcccctttggaaagtggattgatcctctcccctgtggaatgacagcttaacctgattaacccactggggcttgctattttatgagcatttttaaacagaaaggaaagatgatatcccagtgcaggtagactttatttttgaaagcatcgtggcccctcacctctccctctcccccagaaccttggccagaattgagtcttcgcgttggggaggccacgctggaaccattgctctagggctgaaggtggaagtagggccactgccgcagcttcagccagagccctcgctgcttcgcagaatttaacaagcacacgactgggattcctttggatatgagaaaggaaggcaagtgcgggcaaagggaagctcctcccgtttttcataaacagaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcatggtctgcagctctgggcccccagccccactgtgaagtcagtcctgcatgctggccgaggcccggc

SEQ ID NO: 7152 - DNA, 1204 bp, Homo sapiens
aaaggttgcctccaaaaacaaacattttgagagccaaaccaaagtctaggctgagtccaaaaaaccaagacggtttgcattggtccagaaaggtcagaacagagagatgcccgggagccagaaataatttcttgcatccatcacagtttgtatggatccaggacctagctagggtcagggcttatttcgaacatgctctgattgaggcttgaacctcagtactactccaaaactgggggaaatgatagggtgcattcttccatcattcctccttgttaactttatgtagataactcctgttcattctcaaggcccctctcaagttaattggtcgcatctaggaggcctttctgcaccaagatctaaactaggggcccttccctttctcccatggacacccttgcacctaacactcacctggcctaacactcgtgcctaacacttttgccacgccactgctgccacatctctcacctggcttctccaccacgtctgtctcccggcacacagcagtgtctttatacatcccagaggattcaaaagtgtctgctgaacaaatgagatgattgcctctgcttctgggaaggtacactctgttctaggagacctctcctgggctctgtggatttctttctccacattcccttcctcttttgcttatatcctcattcatcccttttcttctcgcagatatcctagtatttactagaacatgcattgtcctgtacctagaactgaaaccatgtattttcgcataccttgaaactgggatacagtttaaatcctaaaagaatgcaccaatgcacctgtaatcccagtacatgggaggctgagatggaaggatcagttgagaccaggagttcagaaccagcctgggcaacatagtgagatcccatccctacaaaaattttaaaaactagccaggtgtggtggcacgtgcctgtagtcgcagctattcaggaggccgaggcaggagggtcactggatcccaggagttagaggctgcagtgagctatgattgtgccactgcactctagcctgggagaaagagcgagactccatctgtcaagaaaaaaaagtaaagaaaagaaaaaaatcctaaaacaggccaggcgcagtggctcatgccagtaatcctagcactttgggaggccaaggtgggcagatcatgaggtcaggagttcgagaccagtctggccaacat

SEQ ID NO: 7153 - DNA, 1188 bp, Homo sapiens
cgagccaccatgcctggcctataattatttctcaactcctaaaaacttgttaactgtggattttatttgatatctcttaatagtaaagatttataactagtttgattattgggtgcttcgtttactttaaataaaatatgtatttctctaagagacctctttgaagtaccaaagttaatcatgagctttgggtatgtgattatattgtgggtctcaaggtattggggcagggagtggacaacaaaaatattgcccgcatttttgtcatgtagaacgttttctcctgcctggttcttaaattaacatattttcatttcctagaggaattaaggaatttgcaagagcaaatgaaggccttacaagagcagctaaaagtaacaacaattaaacagacagcaagcccagcccgtctgcaaaaatcccctggtaagaagactgtcattctggcaatcgtgtgcatttattttattagaaattatcacatcatttctgcatccaactcctgtccaaacagccctttgaacctctttctgaatgggtttttactcacttattttacttttgattaagtagagaagtctccccggccacctcttaaggagaggagagttcagagaattcaggagtcaacatgcttttctgcggagcttgatgtccctgcgctaccaagaaccaagagggtggctcgaacaccaaaggcttcacctccaggtgtagtacttgcggtctcagtatcttggcactattgtatgtgtttatgtgtgtgggggtgttcatgtgtgtgtgggtgtctgtgtcttttggtctgtcttatgtccccattgagaaagaaagtttcttgggaatggaagccacatgatatattttgtgttcttcgtctacatctcaaagtgcctagaaaatccttagggccaaggcacgcggcaggaagattgcttgatcctaggagtttgaggccaggctgggtagtatagcaagaccctatctctacagtaataaaattagccaggtgtgttgcttgcctgtagtctcagctacctgagaggctgaggtgggaggatcatttgagctcaggaggttgaggctagagtgagctgtcatcacaccactgcactccatcctgttccagagtaagaccctgtctgagaaaaggaaaatccttaggtacagagtagctatttactaagt

SEQ ID NO: 7154 - DNA, 1617 bp, Homo sapiens
aagcagcagaggcagagaagctgctgtcatgtcaacactaacagtcattcttgttttcttttgccaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaaggg

SEQ ID NO: 7155 - DNA, 1619 bp, Homo sapiens
aggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtataactcaaatgttatttttcttgcatttcaaagcttgcttttatcttccaagaagtgtaaattttagtatttgtcatctctcaggacagatacaattaataggaaatagaagtttgaagaaacagagatggcacatcatagcaaactaagttcaaaacagaataaccccagtgcatcaaggttaaggtgggacagtggtttgtgatgccagggagagtggggaaattgtgatgatgctggtagacctgggcagactgtgttcccagccacacccgccaacagaggaggaaggtgctggtactgatgtccccacccgagagtctgtcctggccttggttttccacagtgagggctcgttctaatgttgcacaatgtcatactcagatatcactgtgacctgttactatgctttagaacccgagaggcctctgttcacatggcagcatgtgtgagtggatgctcccggagcaggtggagtggtggcgctggatagcggtaagagcgggggctccaaaggcagaacttccagcttcacatctcagctctgcacctgctcgctgtatgactttagcaagcaactggatctttctaagcgtcagcttcgttgtcttaaatggtagttggtaataatagtccatgcttcgtagcatcacttttgtgttcaagcagaatgctgagcacactggcaaataataagagctcgtaaatattagttgttgtgtcactgttgtcattagagggaagccagagtccctttcaggagccctgtgtttaggggcagtgtgtcctcacaaaacaataacagtaataatgatggtgttagcagcaacagcagtaatcatggaaacgttgattaagcatttactgtatctgaaccctgcggctgttcctgctttcagccacttctgcattgagaagggccggggatgtggtggaagctagatgtcaccaagtagggggatgtagattcacagcggtctattctggttcctcttgggaggttcaaaccttggggaggt

SEQ ID NO: 7156 - DNA, 1241 bp, Homo sapiens
ggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatag

SEQ ID NO: 7157 - DNA, 1159 bp, Homo sapiens
tttcccaggaagcctggcatgctcacagatgtcctagagccctcacacttctcacaggaaccagttccccagcctgcagtgacaggtgaggatcacaaccctctatgtgggaattggaggcctctgttttccagctctgggaccccgggtgggtctttcatccttggtgttttgctttccccaattagcagcaaaggaaattcctgacctcaattagtgattggtcagatggcaccacgtttgtgaaattgcttgaggaaatacgtgccatcttttactaatgtcatagttaatctagcatactatcactggccaacacttgcatgaagtttaaattctctaaaaggcccgcaaattaaatcagagatgatgacgtaccctttgggaattacattacaacacctttctgtttctggaatgttctttatagaacagcgatgtgattgatctctgatgggcagcacggcctctgggtgagtgatggccgacagggctgggacagagagcttcataacatttctaggcagccagttctggctggtatcctggccactgctcacactctactgtactgggacatgccaaccattcctttctctgaagagcttcagcaaagcccaggcctcccaaatgatgtttatcaaccctagagagacaagtgaggtctagtggttcgagtcagcaagggtagggagccatgagggttcaggtgctcccctgacactcgggttttttcttctttcagggtcactgtgcaaatcatttaaggaaatctctccttctttctctctgcctgtctctccctccctccctccatcagctctccatgcatatacatcaagaaaccattctacgatctaagacagggcggagggaggctgtgctggttggttatttgtagctccttcagaatgagaagctgcacaggcaccaattataattggtaacttctatgctgaccccagagatcagaaacgttgtctgctagatcccagcagcctctgaagcccagagccaaggaacgtcttagagactttgcaggaaaatatttgaaagttcaaaatgtttagagtcgacattagacacttttccctctgaactcagagtggggacttcttgaattggcccccaatccaaacgtctttccttcttcctaatc

SEQ ID NO: 7158 - DNA, 1304 bp, Homo sapiens
caagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattattt

SEQ ID NO: 7159 - DNA, 1125 bp, Homo sapiens
gcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggtgaggggctgcggagctgggctagggcttcatgacggccacccggttttctggcgctgggtcatccacaggcttgagagcggcgtgtcgccggcctagggatgtcgtggagtggcgttgccgcgaggacactccggagcgaagggccgggcaggcccggcctcgcgcctggcgattcctccggaaagtcgtctactccgcggcggaggctcgcggcgatgtagacgcgcggggtcccagggcgtcatggcggcgggatgcccggaggggtcccagggacgacgtagctgcagggtgcccgggggggtcccggagacagcggggccgctgggtgtcccggggggtcccggggacggcggggctgcgagcattttgggggaggtcacggggacgtcctggcctctggatgccggaaggggtctcgctgacgtcagggcctcaggattcccgcgggtgggaggtcctgggaaagttgtggccgcgaggtacttggaggcggtggtctctgggacagcagggccgcagaacgcgctgagctgggcccgaacgtctaggtcccggaggggcggggaggctgcagtcgagctggggctgatggtcccgcaaagctgcctggctgtgaagccagttgatggtgcgtggtctacagaggtggcctttctggaagtgagagcctgacaggacttgtggcctttctctcatcagtggggaggcagaagaaacgataatcatgaactccgttgccactagtcccgcgtttaaatgtcaaatgacttgttaggaaaagccaaagggaataatactacttcatttgtagaaatgggaagaaaggggcccagcgcggtggcttacgcctgtaatcccagcactttgggaagccgagg

SEQ ID NO: 7160 - DNA, 1128 bp, Homo sapiens
ttattaacccacaccatcctttcaagacaattcattatgatttgacgctgaatattaacatttatttgtaaatatttcaaagggaactaactacatttccttgggagttaacttactctaagggtcttgaccatgtaagtaccctctatcactgataataaagctaatataatagaaaatttgaaatttattctaaattgtcttaactctctttctcctatatttctttttctgtgtcttcaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaag

SEQ ID NO: 7161 - DNA, 2038 bp, Homo sapiens
ttgttatcaaattattaaccacttttaaatagaataataactacatttgcctccataattgaagcagattactaattaacattttcgagaattaaactgcttgcttatgaagtagctattaaaactaaattgaaatgcaatggatagtttcttgtagatttaaaactgcattgtactgtactttgtctataatgaaaatgttctattcaataaggtatctttttttcttctttttggccaagatggcactaagtaaaatttaaatcgagagatggcataatccatgagtcagccagactttcagctggaaaaatctttagtaaataccttccttctaaattacagaaagtaacttttccatacacactgtaaacagcagacactctaacagagcatcggttatgctccatctcctaacctgaaggactcttgtcacacacccacctctgagaacccaagctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaaaatgatgtgttgcttctgaagacaatggattgcttggcatttgggatctttcctttaaaactgataatgcttccccaattcagttccatctacctgactgactagaacatttactgtggtacattttccaggtttgataggaaaatgctaagcgttgtatgacacagatattcttgctcacaggcactctaccagcctttgaaaaagtcaatttaggctggacgcggctgctcacgtctgtcatctcagcactttgggaggacaaggcaggtggatcacgaggtcagttcgagaccagcctgaccaacatggtgaaaccccatctctactaaaaatacaaaaaaatgagctgggtgtggtggtgggcacctgcaatcccagctactcaggcggctgagacaggagaatcgttgaatctgggtggtggagggtgcagtgagccgagattgcgccgctgcactcctgccttggcgacagaacgaaactctgtctcaaaaaaaaaaaaaaaaaggccaggcacggtggctcgcagctgtaatcctagcactttgggaggctgacgtgggcaaatcacgaggtcaagagacggaaaccatcctggccaacatggtaaaaccccgtgtctactaaaaatacaaaacttagctaggcatggtggtgcgcacctgtagtcccagatacttgggaagctgaggcaggagaattgcttgaacccgtgaggaggaggttgcagtgagctgagaccgcaccattgcactccagcctggacaacaagagtgaaactgtctcaaaaaaaaaaaaaagaaaaagaaaaagtcaatttacacacgcatgaacactagtttcaataaatgtctgtttggctattcctaattttgaatatttcctgcacttagtatatctgtgccatagttacaaagagtcttacacatttgaatattaccaaacaggaccctatgaatctatgtaagtataactcattttattagtttcaaggcttctttacaaggtgtcctttcacaaactgtatgacatgacaagtttatgcaagattactttggagtagcttttttacttttgggtggtttccttatcttattagggtttggaatcagtttctttattttaaggggttgtaatgttacagaagcctgccgaccgtcagcaagctttctcttaggttttgacagatcttcaaatgaagtgtccaaaagctctctgtcttggctttccagaggttcagtctctaaattttccccagaatcttcaattctgtcttgaagccatggtacacttaaactggggactctggggatgatggctcttacttcgtccacaaagtcagtg

SEQ ID NO: 7162 - DNA, 1230 bp, Homo sapiens
tgacatcattttgtgacatgtgcaaattacacaaaattcaaattccggtgtccctcaataaggttttattggaacatagccatactttttttttttttttttttaggacagggtctcactctattgtccaggctagaatacagtggcacagtcaacagctcactgcagccccaaactcctgggttaaaatgatcctcctgcttcagcgtctttttgaagaaaaagaactagctgggcgtgcataccaccacgcctggctaagtttttcattttttgtagagacaaggtcttgctatgtttcccgtgctggtctttaactcctggcctcaagtgatccttctgccttggcctcccaaagtactgggattatagacatgagccaccactcttggccacagccactttcatttacatattgcctatggctgcttcacactacaaagctgagttgagttgttgtgacagattgtgtggcctgcaaagcctaagatattcactctctggtcttttacagaaagtttgttgaccttggtcactacgaaggagttggaactctcctttctataggttgccgtgattctaaagaccaacccacagctgtgacatccctgagactaccaccagagggcgactgggccccacagtagtacataatataggacctctcttggagataatggaagacttggaatttcagatggttccaccctaattgcattagcgttctttcttaacaggagaaaggcttcaagaaacaaaacagtcctcattcactggaacagggtttgagataccagcattaagtaaatgagattttgacttaacctggagtcaaggctctaatttaggactttacttcccactcattttcatgccacaaagtctatacaaagtaggttttcaaataattgcagaatcagccaggcacggtggctcacacctgtaatccctgcactttgggaggccaaggtgagcagatcacttgaggtcaggagtcttgagaccagcctggccaacatggtgaagccctatctctactaaaattacaaaaactagccggacatgggggtgtgcacctgtaatcccagctattcaggaggctgaggcaggagaatcgcttgaacccaggaggcggggttgcagtgagccgggatcacaccactgcactccagcctgggcaacagagtgagactctatctcgaaagtaaaataaataactgcagcattgcc

SEQ ID NO: 7163 - DNA, 2043 bp, Homo sapiens
aatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaactgtctttgtggtcatttgaattcattctgagtcattatctgtttcaaagttgttattaagactttgtcaggccaagcatggtgactcacacctgtaatcccagcactttgggaggccaaaggaggaggatcacttgagctcaggatcacttcagcccatctctgtgaaaaaaatttttttaattacctggttatagtggctcatgcctgtagtccccactacttgagaggctgaggtgggaggatggtactgctgcactccaacctgggtaagagagcagatcctgtctcaaaaaaaaaaaaaaaaaaaaaaaaaaaaaaaaaaaaagtctttgtcattgtttcc

SEQ ID NO: 7164 - DNA, 1222 bp, Homo sapiens
tttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacag

SEQ ID NO: 7165 - DNA, 1233 bp, Homo sapiens
gtgtcattaaagttcgatggaagtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcgtgttttttttttttttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccgtaaggctatgaactccaaatataattgctgacaagataagcaatcctcacgcatccttttgagaggaaataaaatcttagttgcaagattacatattctgatttggaatgctgagctttttaaatggaaatatagaaggacggctgaatcagcaaaaatcctttatgtagtttcattctttgcaagcttgaccagtcattctgaaacaggctaactgaactgatacagtggc

SEQ ID NO: 7166 - DNA, 1167 bp, Homo sapiens
tgggagctagtctctagtggaaacatctttttttctctctctctctattgctctgctagctaggtttctttttgttaggttaaaaaaaaaagaatgatgttcttattttttaaaaactaggtactgcgctgagaattacagattggggtttgatcgcaagctctgccaaagctgtgaattgaagcaaatcacatcagcactttgaacatctttgttgttcgaagagccaagcaaatattgaatattgagtgctagtaggtaggtattgtgctgggtgcattgtctgtctgaacttttatcagcaggcatctttcaagctcccgctgagtgtgaataaagtactaggctaggtagtgtggggcacaaaagaataaaaaataagatccccgctcccaagagcttatttatcaacacacgaatagcctcttttaggagggtcagccagtgtctgagccgtgtagagaaaggtcacggtcactgagtgctcagtcaactgaaatccctcaaatctccagtatgttcctgctcagagcataggcgtcccctactgttgcaaacctaagactgcaatccaataaaggagaccagcaattccagttcctgatggtacttagacataccagatactgggacaggcagggctgggcagtgggccagcagctgcaaggttatgtcctggcgttagaggctggttcatgactgagacacgttctctcactaggggagacacaggctcttccaccttggtccgaggctgtcggggaacatggctggggtcttcgtctctgatgtgctttgtgctgaatggaggtgtctgggtcacttttcttatttaagatatcttaaaatgagaatagagaaagcagttttggtaggaatggaaaaagatgtagccactgcagaaaacagtatggcagttcctcagcatattaagcataaaattaccatgtgatcagcaattccacttttgggtatacacccaagagaactgaaagcagggaccgagagagagatttgtacagccataacctagcagcattattcacaatagccaaaaagatggaggcaacccaactgtccatcagcaaatgaaagatgagcaaatcgtggtctgtacatacatggaataattttcagctttaggaaggtatttctcacacatgaaga

SEQ ID NO: 7167 - DNA, 1450 bp, Homo sapiens
ttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaagatgaaattggcatcagtgtagacggtgctgattgggaaaagttcatgattaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttgagcgtgtcatgtccttcatctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataattta

SEQ ID NO: 7168 - DNA, 1145 bp, Homo sapiens
aagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggcaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccataca

SEQ ID NO: 7169 - DNA, 1161 bp, Homo sapiens
taaaaaaaaagaatcgtgagacatcatgtaatccaacctcttaatgttacagataagtaaactgaggcccaaagagatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgttcagttcactgaaatatttattgaacacctactggaaccaagtgactgtgctagtaacttgtgatatacagtagtgagagtccaggcatgtaaccgatcattataatacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgt

SEQ ID NO: 7170 - DNA, 1119 bp, Homo sapiens
gtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcaggtaggggtttgcctattattatttttctccttcactcccaccacctcccttcttctgtcccaaaacgttttcaactgttgttacgataatacttgaaattaataaatgacatttaattaaagtgaaatttctcagtttttaaattttctaatggaaaatacaaaaatatcttaaagtcttagatgatttggtgtttgggaaagatgttcggcactaatttgattttacttaattaaatgtaggctaaacaatctattggtcattcattacttacaaaacacttagaatttatttcctatttttgtttcacctgcacagtattttttttttaatgcagaatttatatttagggtgtgagagtttttaccctttggtttttgttttgttttgagctccctttctctaaacttcaattttagtaatcattttctaaacgactcctcacacagatactacttgaattaccctatcctgagacatttttatatcagtgataaatgattttaatttatggaatccagcagtcacattttatttcaggagatatctgaa

SEQ ID NO: 7171 - DNA, 1172 bp, Homo sapiens
tacttaaatgtctaatgatctcgttattgatttaaagcgatggtattcaatatagatttttttttcttatttaaatcagtcttaggaatagcaagactagatatttaagtggttttgatacgggcttcagcataagctttttaataagcctttaatcttacacataatgtaatttaatagggtaaataggtttctttttgtcttttattattctagctcctactactgattccttgaacagcagtaagagccctcatataggaaacagctttttacctgataattctcttcctgtattaaatcaggtaatttttgtatggttattttcatctatgttgatttacttgtgaataatagtatattaaatggtttaaaattattttaaacagttttgcagtgttctttaaacttagtttctcttctttcttacgctgggacttaatgtccagtggacttagtttctcttctttcttacgctaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacaggtaagaaacttaagtatgttttgggttttttagtataacagagtaccggtgttgtctatgccttagattggggctttcaatgtgttcctttgtagatacaccttaagaagtctgccaaaaattttaagtatattatacagagtacatttatttttgaaacttaagtaatttagattaaaattaagttacttttagtaacagcattatgttctgtgctgaaaattagtcttaatctgtgatgtctgtttttaaatactagtttttcttatttctttgtatactgtatcataaattctgaagaaagatatcgtagtggagataacatgaata

SEQ ID NO: 7172 - DNA, 1588 bp, Homo sapiens
tgcagagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtt

SEQ ID NO: 7173 - DNA, 1221 bp, Homo sapiens
ctctcaattctcctgttaccaaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggatttttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagctgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccg

SEQ ID NO: 7174 - DNA, 1161 bp, Homo sapiens
aatgtttctcatgctaaatattaagtacaggaatgtctcctgctttacctagggttcaagtgtgtttataaaccctgctctttgtgaggtgtcatggagattgaaaaatatttatgtgattcctcatgaaaatgggttaaaaaatggaaaatgtggttaatgctacaattaaattaattagaaaatagttcacaaaaacttggggacagatgaggggacagagcaactattcattctggtgggagagtttacatctttaggatggatttcactagagggataaattatatctctcttttacctagaatgatttgcattacagtgatagctattttagcttcatgcaccatttgttaaaaacaatacaaaggatcaaaggtagggatagatatattccttaagttgttatggtcatttcaagagtcagccaaataataccgtgctttactgaaattgcatctttgaaccgagtgaaattgtgataatacactggtctgaaatttaagaattgtgttctagatcgaatgtcctaactcactctttaccttgggaaaataacataaaggaaaggcatgagactagagaatctctcagattctagctttcaacatttaaatgtgtagaataaaaggtgggatgcaagtgagctattttttgcctcttgcttaaaaaaaggaaatgtaaaaaaatcttcacacctcagagttggttgctgtggacaaaagaaaatgtcagtacacgttttttcaaaacagactttatattttagagcagctttaggttcatagcaaaactgagtagagggtacagagccttcacatacacccctgtcctgacacatgcatagcgtctcccattagcaacgttctccaccaaatcgataccttgattaaaatcaatgaacctacattgacacatcattctcacccagagtttatcttaggcttcacccttcgttgtttcacattctctggattggaataaatgtataatgacatgtagccactattacagcatcatacagaatagcctcgctaccctaaaaatcctttgtgcaccatctattcctccatctctccccccaactcttgacaacaactgatcttcttactgtctccatagttctgcctttcccagaatgtcatgtagttggaatcgcat

SEQ ID NO: 7175 - DNA, 1697 bp, Homo sapiens
agtaactgtggaatgtgtccccccacctatatcatacagcaatatttttttgatctacaaagcacaccatatacttcactatttattctgctgaggggaaatgggtgagactgccagatttctatgagaattacagggttttcaagtcattatggagaaaatgattgaggttcagtgtcattggaaaaagcatattcttaatttgtctataatttttcctttaattggtagtttggctccattttcaaagtacttttgaagctttcttttccaatttggcatcaaagttatttttctaagtgccattcaatttgggacttattttctattttgattgacataaaatatgtcattctgaaaggaaaaatatcaacacagtttttgagtaagaaactcagtaacattgaacttagtaatcacctccctaggagtgaaatttcatggtcatatatattgaaaaaacctcacaatataaccaacatgctatctgaatcttgattgagattccacatcataagtgctaatttcagttctgactataaccaatttgttagtttatacttactctttactaaaggaaagaagagtaggaataggatggtgcggtggctcacacctgtaattctagcactttgggaggccgaggtgggtagatcacatgaacccaggagttcaagaccagcgtgggcaacgtggcaaaaccccatctctgcaaaaaattataataattagccaggcgtggtggcatgtacttgtagtcccaggtactggagaggctgaggtggaaggatcacctgagcctggggaggttgaggctgcagtgtgtcgagattgtgccactgcacttcagcctgggtgacagagtgagaccctgtcttaaaaaaaaaaaagagtgagaataatgaaactgtgcacacgcaggccttttaataaactttccccctgtacgcagcccattctagctatatatatttcttggtcccagcctcttcaaataaaaattgttttattcaaaagtatgacctagccttatacaagataagatagcccacttaaaagtggcataaaaggccacttttatgcatctccattttaggttggttacaagaggcacagagagaccaaagcccatgggatgctcgtgagagtaggaaattgggtgggaagggtggactcgggagacaacctgacatctctctacttgaagcctagcaataaggttcaaaggttcctcatgccttgttttcccttctctctacatgattaagatcccattcctgtaacagatagcaatgtgtttatgcagtaaaattagataagggagattactagggaagtcactactcagttagggatgtcagtggtgctcactgcaggtccaggttagtaataagaactctggactagtagctaggagtgcttgaatctagattagttctactttctaactcgatgtgtgacattttttccacttaatttttttggccttggttatcttattggaaaaaatattcaagttgcacaaataactaaatgatgcctgagttttcattcagttctaaaacttctcaactgagcaatctgttgttgaaaggagagtacgagttctaaaagctactctagggagctctgcattcaccaagccgctccatcattgttgggaagaaaatactaaggttgactcattgtcaaagcca

SEQ ID NO: 7176 - DNA, 1636 bp, Homo sapiens
tttttgtatttttagtagagacagggtttcaccatattggccaggctggtctggaactcctgaccttgtgatccgtccgcctcagcctctcaaagtgctgggattacaggcatgagccaccacacccagccaagtccagctaattaaaaaaaaaataaaaatcgtagagatggggtctccccgtgttgcccaagctggtgtcaaattcctgacctcaagcaatcctcccacctcggcctcccaaagctctatgattatagatgtgagctgccatgcctggccttaaatttttcaaaagcttttaaaccaatcttaaaatgttttatcctcttagaatcatgtccctagttttatagcttggaaattcttgctcttttcaaattgctctttaactctggcctgattggaaggtggcagcttttcaaatacaggtcatggcagcgctcaacctggattcctcagttgcagaagactgcttttgctagactgctgaatttacttccaacttttcagatgtttctgaggttgaccctggtgtggttcccactcaaagtggagcaagcaggtgggtggcaggtctcttcttagcggcttcctagagggaagcctcgtgagtgggatgggggacaggttgccctgggggagcccaggaatggggagacaaggccacctgctatgcagatgatatagtttggctgtgtacccacccacttctcatcttgaattgtagttcccataatccccacatgttgtgggaggaacctggtgggaggtaattgaatcatgggggcggttttccccatgctattttcataatagtgagtgagttctcatgaaagctgatggttttataaggggctttccctttcactgggcactcattcttctccttgctgctgccatgtgaagaaggacgtgtttgcttccccttcaaccatgattgtaagtttcctgaggcctccccagccctgcagaactgtgagtcaattaaacctctttcctttataaattacccaatctcaggtttgtcctaatcgcagcatgagaatggcctaatacagtaggttttcctgagtcctctctctgactcaccctctgacgggcaaaagacagtggcagcactgccagcaatcagctgggaacttctcccctgtgatagaaagcagtgcttgctggcttccctttgtgatgcttttggacagcagctctatggacctatgccttttgtcctttgaggacggacgcacagtctgtgcagctcgaggacgccgtcatgggtgagatgctgtggagtgtgatgacgccacctcttaggctgtgtgtgaaagtagcgaggagaggcagggtctgcatgagccactttggagcaggccaaaacactgtggagaagcacattacagccacagtggcggtgtaaagggtcagactgaccactggcttctggaaagtcttcatttctgaaagactgtcaggtagaagatggatgagagttactctgtgaggccggaaacctagaactcagaccattgtgtgcagaccagggagaggcagtgtttggagtgagataagcaggaattttgaaattacacagacccggttttgaatttactcatgagctgtgtggcttagagaaagc

SEQ ID NO: 7177 - DNA, 1150 bp, Homo sapiens
cctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaattctacatattccatgctgtttaccactgtgcagtattctgccttgcaaatgagaactataagccccacctccacacaacagagaagttaattcaggagtgaattctaaacatttcaaccagaattcttcaaaaattgtttcaggactagatgctaagtaactgctcctaaaggatatttacaatcataaacacagtagaatttgcataattatgctgctaaatatacacatgccattttaaatataactgccctagctagtatattagcacaattatgcagaaataggggaagaaagaggacagcattcttggtagacttcatttttttaaatgcatctgagtactatgtcaaagaaaaatgttaaaaacaggaacatcagaaacaattaccgaagcacaaaattataatccattgtctcatctataccatgatgttatttagaaatgcttaatctgtgtaagtattgttaaagaattttcaaccccttaaagcttaacttcatgagcacagggtcgtataaagaaccaatccaatttctgttgcaatttcataatattaaaaagcaaataaatatgagagtgtttttcatatgagagtctcaagtgacattttacatcgaagatgtgaagctgcaaaaacaccagtgggaggctgagaaatcggtggctgtgctttctgttggcactgctgggttcttatgctgttctgaagagcacttcaatatagtagcccaaataactgtgggatgttagaaatca

SEQ ID NO: 7178 - DNA, 2080 bp, Homo sapiens
catcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttggctttttttcttttgagtcctcaacttaaaaaattattgttggcctagagggaaatacgcttacaccatatgttttcatttgttaaaatgggaagaagccaggcacggtggcttatgctttgtaatctcagcattttgggaggctgaggcaggaggatcacttgaggccaggagttccagaccagcctgcgcaatataatgagaccccatctctaccaaaaa

SEQ ID NO: 7179 - DNA, 1313 bp, Homo sapiens
ctgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttgcatggcttgaaacttattctgatatatttttagatgtcatccatttataactaccttacatgattaattggtcctgactttaaaaaggtgcctactatatttatacattccatcttctcctctttcttgctgtggtgggtagagactctttcttacagatgcttacattagcctaacctcacttgttgactgatagtgtttaactcttctaggtaaagtaatgtatgttatgttaatgttcttttcgtgagtgaaacgaacatgagtttggagtcagtccagctctacctaggtatgtgaacttgaacacattatttaacttctctgaatttgttttctcatataaacagttagttacagtaacactacctattataagggtgattagatttaaatgagatactgttccacttacagtgcctgccacacactagtttcaaaatagaacaaagctattgttgg

SEQ ID NO: 7180 - DNA, 1153 bp, Homo sapiens
taatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaattagtgtaatggactactgtcaaccacaagatggcattcctaacataatttgtctttgataacattcagtttcattttctgggagaacaacctccataaagaaatatattgaaagttgtaatgaaaacattttaatagtttaataagcaagagaaatttgttttaatttttttaaaattaaaccaattatatattaacaccagatctctggcttagcttctaaaaaggaggttctaaaaccaaaaattgaaaatcaggagcagttataggaaaaaaatggaagattcaaagttacgtttgttcatgtatgtctttattattttatcatttacttttaaggatatttcagtagatgatatatttagaaactgcctctaaatattcactatacataagaatgcattattttgcttggcatggtggctcacacctgtaatcccagcactttgggaggctgaggcaggcggatcacctgaagtcaggagttcgagaccagcctgaccaacatggagaaaccctgtctctactaaa

SEQ ID NO: 7181 - DNA, 1221 bp, Homo sapiens
atgggctggaacttccttcaagaacagattgcaaaaggcagccgaccagggcgtgtcaggtcactgccaagggaagcagcagcggaaaccgtcgcctccggcttaggctgcggagcgggaaccccattctctgagttatgtttctgcctaaacacgcagaacaaaagagttcgtggctgcaagggtggcgcgcggtagtatttcttgctaataaaaggtccccacagggacatttttgctatgactgcaggcgtggccagtctccctgcacagcttccgggaagaggtggggataggaggctcgccccggggaaggttacgctcggggtccccagaccaggtctccgcacgcccctgccccgtcgcctcccgggagcggctgcagtccccgttggctgcagacgggcagacacccgaagtgtccgcgccggcagccggaccgcaagcgaggaagagcgaaccgcgctcccgggcctggccgaagcgcttcctgtgccaggtttccggctccgggtcccgggaggaggatcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggtgaggttgggaggcgcgcgcccggcggggctcagaggtcacggctccaatgacagcagtgggcggaatgaatgggagcggggagcacgtgcgtcgcgacgcgggggcgcgcggggtagctccggggtagctccggggtgggactccggagctgaggggtgctcgcggtgggacggagccgcgcgttggactgaagtaggggcgccctacacggggttgcagaaagcggtgtcctggggaccccgggagcgttttggggggtggagaaagcggtgggatccgtgtcctgggggaagcgcaggagcgatcagattgaccgctgctatatggacaaggttaagcctggagagcgactgcagctatttactttggagttagaggaagacagatcttgcctgaaattttagagccaaagtgctcagagctctctccgagaaacggaggatcgaatcggcctcggaatagtccgaaaaggtcttgtggagaatgcagggctggtgctagggtggacc

SEQ ID NO: 7182 - DNA, 1111 bp, Homo sapiens
atttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaata

SEQ ID NO: 7183 - DNA, 1198 bp, Homo sapiens
tggtttactgaatggctatgcagctttctttgcctgataattattttgaaaagccggtgctttgcatatgataggcacttggtatttgaatgaattgaaacatctaataaattctaaaattcagagagctttcttaaagtgattgacagaacctattgatgtattcagtctaatcagattgtcatttggctctaagattaagccaatgatttaagtacatggttggccactgacctacttatattgatagatacaaaaattaagaaatcttcataaaaatagttttgctgtgctatatatttaattgtctttgtcttaaaattcaagtaaattttggatatagtgcactcatgtgatatttcaactgttttttccatagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagt

SEQ ID NO: 7184 - DNA, 1195 bp, Homo sapiens
ttccctgaaatatttttgatctatggttgattgaatccagggatgaggaacccatggatatggagggctgactgtatttgcctcgcatactagtcaagaatgacatttattatttcaagagcaaaccagtattgtacgatactccagctggagaatcagtgtctataaaggtgaattatgtttctaagagttttaatgttgctttacaggccagtatctactctggtgtttgcttattttgtgactttactacatttatctatgatattcaatatatatttcagtaaaatgcaataaatgtaaaataaaattaagataggaaagttacttttagaaagcatgaaaatttaagaaatccttggagagcattgaattagccccttgatttttagtaaatgaaatggagactttttatattgttaaaaatgtatatttttaaagtatgataatgaaaaatgttaggaaagaaattcttagcttttcaagcatatttttgaaaaaggagaaaaagccacttataaacataggcatatttgatagttaaggcaggtataaactcggtagcctctttatgtacaaaattcatactcatttgagcatgctttacatgggggtatcttttttctttttcttcccgatacattgtactttcttgctgtttcaaaatgttgagttttcttttcttgtactctgacctgaattataaactattttattagaaaacatttctgtccctcctccttctggagctccaccagcaccacctctggcaccacttctcccagtgagcactgtgataggtgagattgcatagccattggagccattgaactcactttacataattcataataaactcctctgtgctagtagagtgctggcttttatagttattaggttgcaggtgataatacaaagtttaaagtattaaatctaatatcactaacttctggtgaaaggcttctgcacttatacagtaaacaaatataaaacaactttttctataatatgaaatgcttggtttataaccaacttaatgtgtttttaatttgttgtttgtttagatttttctagtctaatcccccctgccccgcacaagtgaaacttaatttggaactctctggtatatacaacagtcaaaggatcagggtgaaggtggggacaggaggagaaaaattgaaaggcaaacgatatg

SEQ ID NO: 7185 - DNA, 1229 bp, Homo sapiens
tgagtaataaatgaaattattaaagctgcagtagtttcagagatagctgtatcaattcattaaactatacatgtttcctataagggcagcttttatgtctaaagtatttccagatgaaattcagagaaaaagtgactaaactatggctcagaatagctagctattttcttttttcccttggaatgtgaggtgttttttttttttggtttttttttgagacaagagttttgccctttttgcctaggctggagtggagtggcacaatcttggcttactgcaacctccacctcccgggttcaagtgattcttctgcctcagccttctgaatagctgggattacaggtgcatgccaccatgcccagctaatttttgtatttttagtagagatggggtttcaccatgttggccaggatggtctccaactcctgtccttaggtgatctgcctgccccagcctcccaaagtgctgggattacaggcatgagccaacgcacccagttggaatgtgagttctttgtgaagagctttcttttacctgttttagacttattagcgttgtgttctctttttacattagccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatgggtaggtttcctttcttttttttctgtcttttacttttcattgtgttagataattcatttaggggcaaatactctattcaaacagctaaagccatggctatgttgaatctaatcttactctaaaacttcagtgtctgggttttcaagatttgtaataaatgattttacaaaattcccaacttaacatcaaacaaatgccattaaactgtaacattttcttgacaataatcttgtcagtgatacagaactgattttatagtgtaccacatttattagttttgtctctttcttagaaaacctttttttctgactggaaagctttaaaaagtgatgggaacatgaaaatatatacttgacaacaccacaatttggcatcttacgaaacaaatatattctagttgcttatgtaattatatagttaaactggtagtggggagatgaggcacgtatacatttcctcttgtcagacattgctgcgaaaaaggatactttattctg

SEQ ID NO: 7186 - DNA, 1104 bp, Homo sapiens
ataaacataataaccttatcccaccaaaggaaattatgcctatttccttaatatcatgtactctcagtcttgtttaaatgttttcaccagatgtctctagaattttttgttctttatgaaaaagcatcaaatcaggattcactaattacatttggttgtttagtcttttaatctatttttacatgaattttatcttatttagtgataaatgggtttatatttttttgcctcaagattctccctgtcatgtctcttgttgatatggaaacaatatttatataatacaggaacattaattttggacaagattctgaagtgaaccattagcagagacaagtacggtttgctgtgtttcaaaatattggttattggtgtgacctcagcctgaaaattatataaatgaataattatttattttataggttcatatcgagggattttttaaaaatactttgaatcattctcgttttcattttcttttaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagtacgttttggtgtatctttgatgcagtgctaaattttgttaagggaagtgtgtatcttaccctttctttgctaattactttttttcttcctttttttaatttctattttttggggcctccagctttgcatgctaattagttttgattgatagttaaaatagccattgtgggaccttggtttgggtaacttactatatgaattatcggaagagctagtggaagtgcaagatgaagttggaggctaccaaaaatctcttagtgttttttcattttattcatcaattttgtagtatggaattaaggagtaattagcttcaaacctgattgtatatatttgtatagctggaaagaatgaatgaatgcccaactgttttgttttatatcatttctttggtatagttttttcccccctgaagatactatttttaagtcagtaaaaaatgacgtccttttctttcagtgaatat

SEQ ID NO: 7187 - DNA, 1204 bp, Homo sapiens
ttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatg

SEQ ID NO: 7188 - DNA, 2146 bp, Homo sapiens
cacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcagatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataa

SEQ ID NO: 7189 - DNA, 1294 bp, Homo sapiens
gaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaattaccttgactttttttttcctttgctgaaatattagtcacatagccttagcttcacactgccagtaatgtatcaaatcacaagggtttccgcatgaaaaaaatcttttcttcccccacaaaaaaacctttaccatcaaaatcttgccatctgatttagaaaggtgtttcttcttcttcttcttttttttctttaaattggtttagggttttttggtgattttttttttttttttttttctgttggggcagataagtgcttccaaaactggcagcaccaagggcttattttttatgttaga

SEQ ID NO: 7190 - DNA, 1907 bp, Homo sapiens
tgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctccctcccttcctttcttccttccttctgtcctccctcccttgctacctcttgccctccttccttcaccctgtcctccttttcccttttattttttccccttctctttcattttattttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttcc

SEQ ID NO: 7191 - DNA, 1246 bp, Homo sapiens
agcctgggcaacaaagcaagaaggaaagaaagaaagaaaggggaagggagggaagggaagggaaggccagagtaactcattttaacagagagagaaaaatgaaatgaagcaaagtctcaaagaagtggtttggcaggattctctgttacaactaactttcggttttgtatttattttcaccaaatagttattttcaattccaaccccatttcggcttagttggcattaagacatacacggtgaccccgcaacttttgtgaagatagttttccagcgaatcagaccttttcgaagaagaaaaaactcttcatagacttggccattaaaaccctgtgtctgtttctgagttccagagggaactggatatcccactgtgcttcagcagctgtgaggtcagtgtccatgacagccccagaacaagtccctgaaattttaagaaaggtgaatctgcacatttatattctcagtgtctgctgccattgaaattccagatcataattcaggagaatgaagtcactttaaagtgcgaggatgggagggagagaaaggctgagggaatgctctctaaactccagatgatcattctgcggtcagggaatgagttggcctgaggttcacatcaccctattgtgtgagcacgtgcatgctgctgtttgaacccaggcacaaaatacttgaaggtgattgcgatgccctgaccaggctcttctcttccagtactctgccatgttccctgtttgttttaacctgcaggaagaaggaggagttgcggatgatagtgccatttctaatctgctttgggtaagcctgactctaacacaggtgtcctctcgatggtggccagaattacacttcgcgtgggtaatcctgatcctgggtggttccttcgtgcaccctccctggtgcttttcttatctccagaccagacacagcctttgtccggagtggagagctgagcccgtgcccttaaactattttttaatcatgtaatgaagatactttaaagaagatgatattttctgtttaatgttaaaactgtcaatgaaagtcatggttcctctctctgtaactgacaatcttctataaattaactcatttaattactgcacaaagctgactcaggtatatttaccgcgcttgtgtggatttactttagcattagcattcaagggaggactctcttgaaaagagaactgaaattgcaatgagtaaattaacattctgttagaaaaatcattgttttgtc

SEQ ID NO: 7192 - DNA, 1190 bp, Homo sapiens
tcatgtccaacaccaccgcaccagggaaatggatatatatttttggactggtgtttttcacaaagtatttttcaatcagagttttcagaacctgacattgttaaacatactgcttgtcccggagttgtgtattttgtaaatgttcaagggaactatttggaaacttctttccaccattcagcagattatcagaattgataagagtatgttatgtgcacttaagccgcagctgctatagatagcagtgccttcttcttccagctagacaatgcttttttttttttgaagcagttctctttataaaatgttattttgatagtttgtggattctaaaatatatgtatatatttatataaacaccatataagtcaaatatgtatttaacaaagcaatatgtattcattcactttcaagattttttttggtgtcaaaataatatgaaaaggtagatggagttgcttctgttgaattagctctgccaccaagacgtatcttcatacacgtttggaaacgtttcctgcagcattaggtatgacttgttctaagtactgcttccggtgctaaaatgaacaacaaatttgtacttaatggcacggaccctggagaatttatgcgaatcaacctttctaccttaatatctccccctaaatgccttgtttttatgtacagtttatatacagaaaagtttgctctgcatcttccatgatggtttggaacattatctacagttttactctcaaataaccaaaataaaaacatctcaatttctaatacctgttgtaaacattacacatcattttgtgatacaggacttttgtcttgtgcgtttggaaataaaaacatcagaataaacataacaattaatttattagttcaaattaaattaaattccaagcatgttcctttctggaaatctttttttttttttttttggtaaatgttaacctagcaccaatattgtatcattaaatattaatggctatatatttgaatttcgtttagggcaagattttatacaagttcataagattaaataaagagctatttgccccataaaattattactcagtactatattgaagacatatttttgcaaatcatcactcaacagaagttcttttgcttttggttttttttttttttttttttttttttttgagacggagtcacactcttgtcgcccaggctgg

SEQ ID NO: 7193 - DNA, 1114 bp, Homo sapiens
acaagcaggtaagggttctaaaacccacatcctgtgcagaatgtttgaaggacctaggtatatttaacctatataagagaagtttaagaatacatatagcagctcttgatccatttgaaggtttgacttgagaagaaaagttacacttgttctgtgtggcatcaggacaaactaggatagggaaataggcatcatagctatttttttggctcaaactcagcctgtctcttagtagaattgcctttttaaaaagtgactagcatttgttgagagcatactaagagttttgctatataatctcatatgacccctataacagtccaatgagaatgtatctgcatttgcacattgaaaaactaaggcttggacaggttaagaaaatactatgtgatggagccaggatttgaacccaaatccatggacctcaacagaaccagacaggaccatcttgtgcagggctgtccagcaggtcctaactccccttttattaaagaagctcaagcagagattagctggtgtcaagaatgatatgaaatgaactcttcattgaaaaggaggctgtactacaagggtttcttaaatctcttccaattcttatatatgattcttcaaataatcatatttattagaaaatataactcacatgtttaaactatagcattgaagttactattaagcaatttttagtagggcttaaattgattcctcactgctttcattttaattcttaaaaagagcaggagatggagagttttattttgatactaagtagacaaatcagtgtcatcacatctcatcattcaacaattagccattcactcatccaaaaaaggtttaatgagcatctttgcaacctgtactttgatgggtgcaagggataaatggcaaacaagcctcagaggctcctgccttactgaagcttatagtctgtaacctttaaattataaattagtgaactataacttaaaactcaaaggaaacattaggtttgtaggaaaatattccatttagctcggtgctttcaaaattttctaccaaagtatccctaacagccaaggagaataaatgccttttaccccacagagtctagggaagcagcttgagggaagcctct

SEQ ID NO: 7194 - DNA, 1256 bp, Homo sapiens
cgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatc

SEQ ID NO: 7195 - DNA, 1153 bp, Homo sapiens
cactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttca

SEQ ID NO: 7196 - DNA, 2233 bp, Homo sapiens
attcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttatttgttagtaa

SEQ ID NO: 7197 - DNA, 1538 bp, Homo sapiens
caaacaggtgggaactggctcatgctgtagtgatgtgaggatgcagtgatcatttaaacccgtaatgccgtgttctaggaggtgatcatttaaacccgtaatgccgtgttctaggaggtactaaaatattttggaattgttatagaaatgaaagtaaatgcatattagttattagtgagcctttctaagaaggtgaaggaggtttgagggagtaatgaaaggaaggaaagttcttctcaactcttgtgtctacctggttagtgtatatttactgttccagttatcggcttttgttttggtcataagtgactgaaaaatgtagattacaattagaatgaaagtgtttttaatgtggcagtgcatatgatagtagacacatgtttgctttttggggtttgagatttgaagtaatgttctttaaatggcctatactatatgatgcttgtgagtaaatacgaaatccagattgcattaacttttttcttcattctctttctccatttaaataaaacagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggtaagattaaaaatagaatgaggaaacactgtaccaccctagtgaaaatattagttatagttttaattgaaatatttgtaagagttaagacttgttttgctttgtattttcagagtacatgggttctatcctgatttagagatctagaaaatatgtgaaataacttgtggagttcataaagggtcactttggttttcataattattcttataccatgacaggactagatctactttaagtgaggaaactttttttcccttttctctatt

SEQ ID NO: 7198 - DNA, 3025 bp, Homo sapiens
aattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaatgactttcttaaaacttaagtgttaggttgattttacatggctgagttcaggccttctgtcttgacagaatagtgactgatatgtcattatatttatgtatattttgtttcctaatgtcttgcagccttttggaccgcagatattaaatgtataggctaaagagctagaaatgaatgaccagtctcacatataaaacttttttttttttttttttttttttt

SEQ ID NO: 7199 - DNA, 1161 bp, Homo sapiens
cctggcccaaatctaaatttttaagcaactcttgtagaatgccattttcctttattacattaatttgcatgtgactgcagtcgatctctcctagccaacttctccatgaatgaatactctttcctgtattactaagcactttatctgtcctgtccctctcttatggttctgaccttctatcttgtactgcacttattcatgtgcctatcttctcttctactgtgttccttaaacacagtctttgattttctttctgccttgcagcatccagcacagtgcctgcacatagttgacatttagtaaatctgtttaatgaataaatgttgccacactgaataccatccatatttcactccatttgttcttgacaaatggtgaagcttcatgggtgttttttaaaacctgtatacttttggggaaaataaattattttctgtcctatagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggtaggatatagttttattttcttttttaatgctttagtacaagtattcttaacctaaaaactacttaaataacttacttttctatgtaagtcaaatatcgataacatcaattttcaaggactcgggtttcaacttcatttctttctgtatatgaagccttagaggtggaggaagacagttattttagttcctaaaggtctgttaatatctaatttaaatgctgttttagaggatgtttgctactcctaattttaatttttttaatttagtatatagcatgtagaatctaatgttactactaatgttaaaggaaaaataatttaaagctgctagttgcccaataaagctattagatgattgttcaaacaataaattaaatatgcagtacaaattaaaatgctatttaatcaactgtgaattatttggaatagatgtaaggatatgtaacttaacataatttatgttttacttactgttacatttccactacgtggaacagtgcctttttag

SEQ ID NO: 7200 - DNA, 1183 bp, Homo sapiens
acagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttgg

SEQ ID NO: 7201 - DNA, 1850 bp, Homo sapiens
gaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttgtagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcatttctggttggtgggtagttcacttatgaagctaaaacataattctttaaaaaaatgtactagggacataaggagagtggtatggtgaaatacagacttgaagactgtccttgggctctctgaatcatggtggatagatccttacttatcctgctacgctgggagagaggtttcatcccaatattaagcagaattaactttatgaacatcttagagccattagt

SEQ ID NO: 7202 - DNA, 1094 bp, Homo sapiens
ggaatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaa

SEQ ID NO: 7203 - DNA, 1190 bp, Homo sapiens
gtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtt

SEQ ID NO: 7204 - DNA, 1183 bp, Homo sapiens
gtgtggtttggttttgctccctgcactgcagtgcccagaaagccaaggtgatggtggggcaccccttctttttttccttttctcaggggttacagtcttagccatcttggtccccagttcctgctgaaaatagttgtttcctatttttgactagttttctagttgcttatagtaggaagttaattctggactactgtatcttcttattgctggaagtggaaatctcttaaaatatatttgaacaactgttctgccaaaggcttctaccatctctttacctcattcttactcttaaaccccttaaaatgggcttcagcccctctctactgaagaaaattcttttcaggtgacaaaattgccaaatctggaggccatcaggaaaatgtgtccacatttgacttataggacacccttcttccttggtcactagtgctctcctgtgtcttcactgctgatccccaccttttggggagttcatttgtccctgttgtgattctcacgtgcctacacccttgtctatgtttctccctgtcacgtcttcagctgtcactggtatgatttccattgacactgtagtagtgccgctctgtggcacacaccaagcctggctctgcacacatgtctctgggcatcctgacagcatcacgaactcaacggggacagatctggtggggtctttattatccagaccgtggctgccactgtgtaccatctctctgctcttttcaccagcaccctgtccatctcctgtgctcttcttgcttctccgtccttagccctcatacctagttccggagtgttattgattctatttctatactttttctcagatcagttcttctccacacattccttgttttgttttgttttgttttgttttgttttgttttgtttcagggatgtattaccccttgtctggcataatgaagtcacagcatttacgtgtccacacctgtctcagcccccttgatccctcttagtcctgtctgttacctttctaaattctagtcagggtggcctcactcaccctctccaaagaacgacggcagaatcaagtccaacttacttggcgtggcattctcattctagggaagcactgctgactcaatccccagtatttatcctcattgaaactagtcacctagggctctttcccatcccatattgcgtcaagcattttcct

SEQ ID NO: 7205 - DNA, 1229 bp, Homo sapiens
ccaataacaacagtgtttattgatttgcacagtatctaggcgcatagatattcctcagactgtttggttaatgattgtcttctatatgtttggaatcactcctttgtagacattagtggaggttgaggtatttacttcatgatctgctatgatacaaaaggaactttgtattgaaattctggctgattaccttagggagttattaattttatgttaacaggttgaattttcatatggagtaatcccctatgtaggactctaggctaaacggagctttgaggctttgtgatgcattcctatgtgaacacatccctggcgaaaggcttttaaaagatacaccccaaaaggaagagcctttagagttgaaaggatgtcagatgtcatcagtcacactttcccatttaacagatgaggaactaagtcctgatatcccatgatgttttttgttttactttgtttttggctatttcctttttctaaaaatagccctctctggggaatgctgagatcttcattctttattagtatcaatttataattatctacatctgtaagcagttattcgaaagtctccagatcttattctatcctggcacccatggtgactaaaaaaatcaaagacgttaaatctttgaaagcagccttcaaaccacatactccagccaacttaccttatatgtcggggagttatggagcaaatacattaattaacttgacagaagttgcacactttctgtacttctgaaccaaaatttggatgcatgtttttctttatcatgagtcacacctgattaggatttccttagcttttgttggggtcagacaggattgtgaccaaaggcaagatttctctgtcatctcttttgacagaatttccacaatcatggattttgtaatagtcctggacattcatcagaaagtaacctgtagtggggctgcctacataggattcttcctttgaaaagccttaaacatttttctaatggttggtctctcttaactaacaataaaaaacagcaacaatgcagctgggcacagtggcttatgcctgtaatcccagcactttgggaggcccaggcaggtggatcaactgaggtcaggagtttaagaccagcctggccaacatgtgaaaccctgtctctacgaaaaatacaaaaattagccggatgttgtgttgcacacccgtagtcccacctactggggaggctgaggcaggagaattgcttaaa

SEQ ID NO: 7206 - DNA, 1195 bp, Homo sapiens
ctccattttactacttttgcatgtacttgagaagacctgcattgtgaggcttagctgtacttttgttaatgtgactgttttgtagtttaatgttttcagaagattgcgtttctttttttttcttacctttcaataagcgttctcaggttgaaagagtgcatatctcaatgatggtatgtaatgttttcatcgaatagccctttggcagccggccttttaaagttagagacagggaaaacaccctgctgtcatatatttttcaagaaaagattaatagctgtgattcattctgcaaatagctattctttttgagagttagtcttgcaaaatttcttcccttccttttattgttgtcctatcaattctgagaaactgagaaaaatgagccttgggattatttctcattatacttgtctcactgaatttagtgggcttatttcttcactcctctcttgtaaatatttgcagactcattacagcatttgcctttcctgtgatttaaattaaaaataaagattttggtaagctgtatgtggcatgatgaaaaaactaggagactgtggaagaaggaattaggagatgggaatgttggatattgctattcaactactatttgattgtgaaaaaaattacttcttgatttttgaacttcaacttttctcaattgttggtgacctctagagtctttgcaatccctttaagttctgtgattttaatggcaaataagtacttttattttacgacctcaaaagtgtggtcattttatgagaaactttataggacatgtagctataggtttttgtgttgctttcagacaaacttggaatgatagttcaggtaatgtgctaatcactacaaatttgtctagtcagcgctagagcagcaagtgtaacttttatagctgtccatgtcagtggattgtgtaaagactaataagacttgaaaagactaagaggtagtgaacagctctccaaatgagttgattgaagtctgtaggcaactgagggtctcatatcagaatacattttctttgcatacattttatgccatgcaagttgaaactcaggcctgctctgtagaagaattcctaaaagaagatgtcttaattttatattttgactttttttctgatttggaagatcattataaaggtgagagaaaacagcgtaaaaaaattgctcatagcgtattcaac

SEQ ID NO: 7207 - DNA, 1174 bp, Homo sapiens
gttttcaccatcaccccaggtcacagcaaattgatgctgtgtgctactggaggcacagctttctcttgtcatcaggccatttacagtgggtattttgttactgcggcatttgtaaaaaaaaatgtggttgctttttcaaaatggggtgatggaaaagttacgcactttggtgtttcataaaaattaaaatgtcaaactctaggcaatgagcttgactcttattttatcaaaaagtagtgtatatagaatagtaggaccagaaaatagcttattcccaaacataaactgcttaagattctggcagatgtaaaagtagaaaataattgggttttttcctgtttgtttgaacaaaagaattatttttctcttaaatttggtaatctataatataaaagttatgagagtggaggcttttttgcttggtcattaatttagcagaattgcttgcagcaaactcttatttaaagattttggtttttataaatataaatgttttatttttaaatgtaggaagatattgatgcagaatcttcgttttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatttgctcttaaaccattagaatgtgtaactatgcattctctccgaaaattcccacattgagaagtaataaaatttcatatttttcatttgtaaaataagggaaagttctccagttcatttttttttttttttttgagacggagtcttgctctctcgcccaggctggagtgcagtggtgtgatctcggctcactgcaagctctgcctcccgggttcacgccattctcctgcctcagcctcctgagtagctgggactacaggcgcccaccactatgcctggctaattttgttttttgtacttttagtatagacggggtttcactgtgttagccagggtggtctc

SEQ ID NO: 7208 - DNA, 1252 bp, Homo sapiens
agacagagtctcgctctgtcacccgtgctggagtgcagtggtgtgatcttggcttgctgcaacctccgcctcccaggttcaagtgattttcctgcctcagcctcccaagtggctaggattacaagcatgagccaccatgcctggctaatttttgtacttttagtaaagatggggttttactatgttgaccaggctggtctcgagctcctgacctaaagtgatctgtctgcctcggcctcccacagtgctgggattacaggcgtgagccgctgcgcctggccttaaagactgttttaacctactggtgaagttatgatagttttactgatttataccatatactcaaaactaatagacttccatcctcacctccccaagaaacaaaatgactaccttgttaacagcagtggctttacaacaatttaataaaattattggttcactctttccgaagaaaatgtctgaaataaagtaaatttgaaatgtttctttgaatggtcaattcactgtcagtttttgttttaattgtaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggtatgtagtaatattccaaagaatttaagcatcatcagcattaaagctttttcatgagatgtttgcagttttaaaataaggctgtaattgttattgtgctctggaaagcacttgtattcactacgttactgtacgctccatagagctgcgagcgttaaggcatcacagagcatgctgtgtgagttggtgccatgtgccgtttatagtttgattttatttgtcctatactgttacagcttattgaataattgtaaaagaattgccatctggaagattttgattaattgagattttgaaactagcctttaaagactttccaggtttttggttttataaatgtgcttaatttcatggttctataacaggaaatgacagcctgttgatgtctgtttgtacacatatttaatatgtgtaactccattccaagtgttcttaatgtcagcactcaattaactgtcatctgtttttaaccaccatatatttttaatatctgtcacaagaataacaagccattagta

SEQ ID NO: 7209 - DNA, 1456 bp, Homo sapiens
tctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatatatatcccgatgaatctttttgatttgttttacttttcttatttttttttttttaactagaaaaaggga

SEQ ID NO: 7210 - DNA, 1266 bp, Homo sapiens
tgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactc

SEQ ID NO: 7211 - DNA, 1207 bp, Homo sapiens
ctcaggtgggatggaagcagggcctaggagagggtacaaaacaaatcaaacaggagctcccaggtaattgtactcccaagctattatttacaatctcaggtggaggacagctcctgtcccattgttcagctgtaactgagtgactgccttgtgccaggcctgtgctcagccctggaggcacaaagatggagccagtctgtcctgtgtctaggggtcttctcatcaggagaagaaggccagacactggaagggtcaagagatcagctgagcaacgaaccggcaaagctcctgggagtgaggtggaggccaaggcagagttggctaagaagtgcatgtggcgtcacaggccaagatgcacctgccagctaggagcaggccaggtcctggcacacaggaagccagtggagcaggagaccctccctaagtaccagcctgtttggttggttggtttgcttttgaaagttattacaatattatttaaggccttttcggataagttcacttttaaagtaggtgttatcaatctaatttctgaacgttatgggtcagaaaaatcactagcaagtggctcagaaaaagggaaaaggtacacttctgcaatcagctgaggagttcacacctttttttctaaatcaacatcatatttgctgttcagaggcaatctgaaaagctgcaaattcagctcacctcaaccccataatttcaaacgttagaggctggtctctgtggtttcctactggttcctgtggggagctcccgctttctttctacatagagcttagggtatttctcatatgccccattggctacctagtgtctcaggtaataaacgtatccgaagataaagcaaagattgctatgggagagtgttgtctcctaaaataggactgtcttgccaggccaggcctcaagaaccagagagaataataaacagcacaggatgaaatcagcatgattgcaaaaggactggactcaggaaaaacaagtttgtttgcccagaacaaattaccagaagggatcaaaaacatcttgtttttctttggtgataaccatatgctaccggattggaatgtttaccagaaaatggaataaagaccttcccactggcaaaatagagccagggttcacccaggatacatctggccccttagtcccatggaaacaaggcccaaagcttatccagtctgaccagatgatttgtggagga

SEQ ID NO: 7212 - DNA, 1213 bp, Homo sapiens
gaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgtagatacattttgagaaaaaccatcatgttttgaggatacatttgtgaaagtgcaggcatgccaatgactactcagttttaggactttctgtggaagaaaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaat

SEQ ID NO: 7213 - DNA, 1962 bp, Homo sapiens
acggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggagttttgccatgagagtgttttgctgcagggaggctggggacgttggcaggcactccgg

SEQ ID NO: 7214 - DNA, 1130 bp, Homo sapiens
gagcaagcatgggcccagtctctggaccagacgcccccaggtgccttagtcctgtggggccaaactccacttgtcacatgggaattcaaaatgcagggttcctgctgataagtgtgagagagagggcactctgaggccagcagccaccatcccatggtgcttctgtggagctgagaggctggatttttggtggaggtgtctctgggttgagagcccagggcctgtcctgagtctgagctgcccttggatgggcttgagctggtgtcttcagacgagccccacagtctggtgcatttcacatcttacccttttgcctgcctgcttgggcctttggagctgtgcccagtgccccgggctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaaggtaactgtcctgtcttcttcttcctgacgctcaccctacatagcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagaggtgaataattccctgaaactaaaaccattgcccgttttctctgattgatggttgctgatatcccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagag

SEQ ID NO: 7215 - DNA, 1130 bp, Homo sapiens; identical to SEQ ID NO: 7214

SEQ ID NO: 7216 - DNA, 1175 bp, Homo sapiens
accgtactcagatgaagaggtttggtgtgaaggtaaagtatcctttcatggaagaggatgctttgactgaagtataatagatggacctttaaatgagacagttacataagtgatgtctgttaaggaaggtatggttatattctgggtcattttttaagcagtatatctggaagttcaagtgtaataggaagtagaattagatttggtctaaatatacaacagcttttatttatttctaaattttattttttccagtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatatagtaagtgttcaataaaagtcggattgatgaaaagctctttgtaattgataatatttaaaatcaagccttaaaaaaaaccgtaatgttctccataaagttttggaagcttcatgcaactgtcgcatcagatggctaaatggtcagttcatgtacattatctgttatgatgacatgggcttttgaatcacgtgtaggtcattcactgtcctaaaataaaatcttgtctaaatatttttttaatatgataaataaagtaggttgtggagtgtgtgtttctgtgtatgtgctagtttatgtgtgtccgtgtgtgtgcatgtacgtaatccacacacaggcactcataaactggtatttcagtaggggtctaaaatgattgcatttataattttgtgaatattatttgaaagttttttggtgactcttattgtggaaaattgaggacaaaaccacataaatgttttattagaaatatttctaatattttagaaatgtttacttgaaatgtttggttttaagttctaacttgtattaacacaattggtacaaaatatgagcctaaaactcaaaataattgatttatcgaagttaaagctcttttccacttactaaatacagtttagcgtttgttttgtatttgaaagaatatgaaatgagttaactaatgagtttcttattatttgctgtaaagtggaaatgaagaaataagaaaataatacttttttaaga

SEQ ID NO: 7217 - DNA, 2519 bp, Homo sapiens
tgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtc

SEQ ID NO: 7218 - DNA, 1213 bp, Homo sapiens
cagaaaagcatacaagtcataagtgtacagttcagtgaattttctcaagaggaacataactgggtaagcagtgctgggggagagacacagtgttaccaggaccccagaagcctttgagccccttccagtcactgacccaccaagggaaccatgtcccggcctaacagcacagatgcgtttgacctgtttttaactttacatacatggagtcatgcagtgtgcactctggggtttggcttcttttgtttctgatgattttttttgtcttctaatttttaaaacatttcataaaatacacttagcataaaatttcctgtcttcatttttaaagcacacagttcagcagcattacattcatttcaattatcgtgcaaccatcagcactatccatctccagaacactttccatcttgcaaagctgagactctgtgcccattcaattctaacttgccatctcccctgtccccagctccttgcagccaccattctactttctgtctgtgaatttgaatactccaggttcttcatataaggggaataacacagtatttgtccttttgtgaatgatttacttcacataatgttctcaggttcacccatattttatcacttgtctgaatttccctcctttttaagggaattcaggcttaaggctgaatcaagttctactgtatgcaaataccacgtcttggtactccattcattgatggacacatggcttgcttccgcatttcagctactgtgaataatgctgctgtgaacatgggtgtgcaagtatctctttgagaccttgcttttaattcttttaggtatatacccaggggagggattattggtaattctggttttaattttttgaggaactgccatactgttttccacagcaactacaccatcttatcatcctgccagcagtgcacaaggaagggttccagtttctccacatccttgccaacacttgttactatctgatcttttgatagtagccatcctagtgggtgtgaggtggtatcagatagtggtttggatttgcattttcctaataatgattgatgctgagtcacgactatggttttcacattactatgtcatctgtcttgtccagtgagctgtgcctcatttattctcattgctgcactgtgttccatggtaagaatagaacacaggagatctgctgttgatgggcactggatggcttctcatttggaatgac

SEQ ID NO: 7219 - DNA, 1257 bp, Homo sapiens
cagatgcgtgccccctgcagtcccggagtgagggcagcggttggggggcggctaggccccgccttccccttagcttgtctctcctcctccaggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagagagatttgctgttttcatttcatgttgtaaaactgggggagggataggcagttgagagaaggtagggaatggggagaaagttaaaaaaatggagagaagaaaatatctgcctccatggatatttttttgagacggagtttggctcttgtcacccaggctggagtggagtggtgcgatcttggctcactgcaacctccgcctcccagattcaagtgattctcttgcctcagcctcctgagtagctgggattacaggcatgcgccactatgcccggctaatttttttgtattattaatagacggggtttcaccatgttggccaggctggtctcaaactcctgacctcaagtgatccgcctgccttggcctcccaaagtgctgggatgacaggtgtgagccactacgccagattttcatttgagcaccaggtagtgtctgttggcttctccactctggcct

SEQ ID NO: 7220 - DNA, 1177 bp, Homo sapiens
cctggtgagcgagcagtgtgtggctcagagggactcccctgggccttgaggtcttgcactgggatcaggactggaatggccctgggtgacagctgtcattgcctagtctagaggctgcaggctctatcactgagtccccaaagctgcgtggggccgattcctgcaagtcaaggatagcattgccctctgagcatggatggccaggtgctcactgaaaagggagggcatagccaggtgggagaggaagccctgggcactggatgcttggggccagggtgctcagagggcctccctggggggcagggttagaagagctgttaccctggggcccagaggtgggtgttgggcctgtgggggagttgcagctgtggctgtccagctgtcccaggtcccaagggtgggctcagggtgagtccgagtgccggtggagtttgggaagccatgggccactcagtcctggggaggcaggctggccagggggatcagaacccaccactgacacagtgtggacagagcctctctccctctcaggcttcttcaacgtagatggggagcccaagagcatgacatgcccagccacggggatccctgaggacatgctcacccacatcggcagtgtggccagctctgtgcccctggaggactttaagatccacactggtgaggttgctggacaggctgcagcccaggctgctggccccaccccaacactgtgcctcgaagggagattggttgggatgcaagagagatggtgtgtcgcattcctgctcagtctgtagtgggtccacgtagctctcggcaccatgtctgtgcccgtgacagtagctcttttcagggtgggcgtggcgagctgggcagctccagatgccacactcccagctgggtaccagtgactagtcttaggttggggaccttggattttccaaatgcctttgccggggcgtccctgggtcaggcagaagagcaggaaagcaagggctcccatacaggggctggaacgcagcctggaacgtgggcagaattctgcagctgaaaggacggtggcttgccggggcctggaccaatgaccgagggcagcccccccactccggggtgagactagaatgtgggtggtcaccgactgcatcccttggctggggccactgtgacctttgcctgggaagtccggagggtcccc

SEQ ID NO: 7221 - DNA, 1225 bp, Homo sapiens
ctgagaagccccactgtcctgtttctcagacctgccagcgctcatccagtgtgcttgctacctcaggagcaaagtgtataacgagggctgccatgacagtgcataacgagggtgcatggacagtgtaccatggatagcctgttgttatcatgagcaaagaagttgtttctttaaagagtgttaaaaatcttgtttaatttatgttgggaaagcctttcaggcatatgaaattcatgctgtattttcaaaagccaagtctgagcatatgccatttagattaagataaaactggagtgttctttctaaggttttttcaattacatactttaatgtgcctctggtctgaccttttgctctccaggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaa

SEQ ID NO: 7222 - DNA, 1135 bp, Homo sapiens
ttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaattcaggaaacggtactctactaagggcggtgaagttagattacatttccaatttgaaggaggagagagtcacactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaaggtaattttctgtcaggagtatctctccaatagcataatatgctttatagttttgtaagggagtttaacgaagctatgatttctagtaaagcaaagaaatggttttgtttcttgttaactacttatgctaaatttaaacctaggctccaaagtttaaactctaaaaaggctagaaacagaaaacaagaaataaaataaatattagaaatcagatttttagtttcatgagtttccttttggtatttatgggaattactagaacatgaaaatactaggttgatagtagctactgtttcttcagccagacattcttctagaccattgtatattacacttttttttttttaacactttgtttaatgccgtgacaggcagacagatggtattatactcactaaatgagataactgagatttgggtaagagaattcactggaatcatgtaccttctgagtggtaatgctgggatttaaatccaggtgtgtcctattacaaagcttatattttgccgt

SEQ ID NO: 7223 - DNA, 1156 bp, Homo sapiens
aaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggacttttttttctttttttgagacagagtctcgctctgtcccccaggctggagtgcagtggcacgatctccgttcactgcaagctctgcctcctgggttcactccattctcctgcctcagcctcccgagtagctgggactacaggctcccgccaccacgcccggctaattttcttgtatttttagtagagacggggtttcaccatgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacaggtgagatagtcattggaaggagtccctcactccgttaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcatgcctgtaatcccagcactttgggaggccgaggtgggcggatcacgatgtcaggagttcaagaccagcctggccaatatggtgaaaccctgtctctactaaaaaaatat

SEQ ID NO: 7224 - DNA, 1156 bp, Homo sapiens; identical to SEQ ID NO: 7223

SEQ ID NO: 7225 - DNA, 1184 bp, Homo sapiens
tgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacac

SEQ ID NO: 7226 - DNA, 1317 bp, Homo sapiens
ctccagtccctaataatgaaaaaccctagagtagaccgaggcatccagccctctgccctgagtcctttctcagctattccaagactctgccccaaggctggtgctcagcgccaggagggatcccaaggcccagcattcttccccttccttgcatatctccctggcttccttcacatcttgactcaaatgatttctcttcagtgagacactccctatttaaaatttcagctcttttctcaaactccttatccactagccctgctgattttccttttggcacgtattaccaccgtgtgccctccatgcacgccattcctggttgcaggctgtggacccttcaggcccttgtgtaaactctggtcaaggcaagactctcaatactatatatactgatatacacatccacatttgtttgtgtacacacacgaactgtagaactagcaccacaagaaactgcaatttcctgtgtttccttgcccctccagggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcactggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaaggtacacccaggggtcttgagtacagggagggaagggcagttagaaaggaagagggaaagagtgagcaagctgagttgtgccagcttgcaatctcccaaaattctagccagaaaaaatagacttctcttggtcttt

SEQ ID NO: 7227 - DNA, 1102 bp, Homo sapiens
gttgcctttggaggccaggcttcttagttcattcaaaaatattccttggatttatgccatgtattaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctgcatataaatgaaaatggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaat

SEQ ID NO: 7228 - DNA, 1405 bp, Homo sapiens
cccaccaccttaaaaaaaaatcaactagttatttgtcatttaaaacatttaaaactttgagtcttcaaatacatttgatgttaatgctgccattacttgcacttccattcactaataacatttctaggtagttatcagttttgtcatattcctggaaaatattttggggttgtaaattctttctcctctttttcttctggagttacaaattgaatttttaaatccgagcacctttattgtggtgtggagaaaattatcacaattttatgtttattttaccttctcagccttctctgagggcactttgcaaatacctgagtccaaacagaagtaccaactaaatgctctatgaactctatccttagtaaatctattaaacctgaataatttaaaagatcatgttcattttgtaatagcaaaatttgattttaattttttatttagaattggtgtatttatcatagggacttccaatttttcttcactttttgaatggatattggctatagttttatgttttaacgggaatgaatttcaagtcataataatcagaatttttagttttacttttttcttttacaatatggattttgttgttatttggatagtggttcaataaatcttaagctcagataattaaacactattttgaatcttaacaagatactgaggctttttttgtatgggatgatatcaacctatgtacaatgaatttaataaacttaagtattgtcagattttttgcacattttagctcaataaaatcttaatgttcaagatttttttatctgcatttggaaatacaattttgtaaaatcaatgtcttacctttttgatacaatagatcatgttttgtttttaataaagcaagaagcccttttatctgttgtttttcagggaagggattaacatttaattctgtttgtttacatttgttatcattgttatccaatgctcattttatgttgctttataagtaggcttaggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataaatgctaaatatttt

SEQ ID NO: 7229 - DNA, 1148 bp, Homo sapiens
aaataaaaagcaagattcgtgtttttcctttgaaactggtgagacttgaatgtatatttgacaattatcatcatttggataggtttaccctttcttaatctgtacttctgttatattactctgtgggaaggatttattcctattactaattttaaatgaatcaatttttaaaaattattaaaatactaagagttctgctgaaacatatggcataaattgtattcacaaggggaatgcattctggaaaagcttttgaaatgatcccattgcctttttaatattgttggaaacctcgtatctgctgtcttttgcttgtggttgaatttatttaattcacctcctgcaagagcttctctgtgatgtttatacttgttataaatttgttgtttaggttttttttttaggtagagttaagaataattattgactttacatttattttaacttttttctctgttttaggattttctcatcttgtttttccctggcaagtacttgagtagtaatatgtttgcctattactaattaatatttttctttaataacagatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtaagagtgcttattagtataatatgcacatttctctgtacatgttcttcccttgaaaattatggatgtcattgtagtactaatatatcagaaaataatgtattttggaattgagttgtctgtaactccccaatgtgaaaagtgagggcaaggattaaaaaattttttttttttgttcactgatatatggtcagtttctctggttcgggaacatagtagggtgattgataaataaatggatggatggctgaatctcaggactataattctggtaattttgttttaaagaagtcttaaatttaggtgcaagcaaatattaaatgtaaatgtgatattgtttatgattttcccatgagaaaagtgctaaatatatatattcagtcatttttctgcattttcaaaatataaaagaaatttaaaatgtggt

SEQ ID NO: 7230 - DNA, 1318 bp, Homo sapiens
ctcaccgcaacttcccctcccaggttcaagcctcagcctcctgagtagctgggattatgcgcactcgccaccatgcctggctaatttttgtatttttagtagagacagggtttcaccatgttggccaggctggtcttgaactcttgacctcaaatgatccacccacctcaacctcccaaagtgttgagattacaggcatgagccatcgcgcctggccgcaaattgattttaaataaatgaacttaaactcttagaagtaaataggcaatggacatgttcactagaaaggaatgtaactaatatataaacataagaaaggccttcaacactcatcacaatcacactgaaattcaataaatgatgtgtgtattatgcacaagtcaatttcttcatcttactaagtagcatatgtagtttacatatgctgtttaagaaagcctatataagatagccaagaaaatctttatgttatatgaattaagcatcaccttccactctgccgagcataatactgattttgagattagatgtttcacattcattctttctcttcctagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaggaaaaaccaacctgcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatt

SEQ ID NO: 7231 - DNA, 1141 bp, Homo sapiens
gcaaatgtactttaattcacaggcttaaagaggttctgtatttggagacatttctgatgatcgtttgacatctttctattgaaatagctctagtcaactggataaggagatcagggcctgaactgtaagcccatgaaatgtttatttacagacaaaccaaatacagcttatatatccttttagaggcaacatgaaaaatgcaatccagtaagaatcactgtcttgttttaggaattttgaggtaaagattgttgtgtcatgttaattaattgccagttgagccaggagttttgaaataatgctttcacaggctttggactcaataatttaaattttgggctgtaagtcagccgcttgcatggactgtttaatgtcctttacacacaaccagtggggtatgtattatatctattatggagatttagatcttctgactgttgaagctagaaaacaacaaagcatttttagtctggtcagcgtaattttttagggaatatttactgcattgcgtcatattaagttttatggtaaatatggcagttctcacttgtttgcttttattctcctctcttcagattggcctgttacccttctgggagccaggagattaatgcaggccccttctcttacattcccttctttgtttccttttatttgtttactttgtttgaattaggctgcctcatctacttttagattttaagtcccctagaggcagggattgtgtctaggttggttttatggagaacactcagcatattgtgggggtgttataaacatgccatctgtggcaatttaaaattcagtttcagacctttcagtacttttctttgtgtctcgttgtttatagaaatctgaactagaatagaggtgcttagcaatgtaaggctatataaatccattaaatatacatttttgtggctttattgtaagtgcttttatagttctagtcatgatataaaggcactatcctttaatttactgatcattaatatcttatatttttattttaaaatttagatacttctagctagtttttttatttgaatattaatcacattagaatagaaaattgcttcattggcacagactacttttttgtggaacatactttcaccagtttgatgatatttattgcttg

SEQ ID NO: 7232 - DNA, 1552 bp, Homo sapiens
ttgcaatttgtagataatgctccttcaggattggcttttgtaaatttctgttagaagctggtttctgcattttgatttttgtgtatttggatacattttcatataggttgcagagaaatccatgagttaaaaaattatttttcctgttttatttctgcatgaacctaagtcacattgacccagtaattgatatatgtgtgattattgcaattaagtataagaaggtagaatatatagttttattagacagatgcttctgaaatattaattttgtatgtttttactatatcctttttgtgtatctacagatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgtttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccacc

SEQ ID NO: 7233 - DNA, 1242 bp, Homo sapiens
acttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaccaagatcattcttttacttgtctatggctgcttttctgtggcagagtagctgccacagaaactatagcccacaaagcctgatatttactgtctgtctgtttatggaaaaaatttatcaacccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattac

SEQ ID NO: 7234 - DNA, 4278 bp, Homo sapiens
cttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtaaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagatagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagaattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgtacctcttgagccttaaaccctatcttttttcatttcggtttttgggaataaaacattgtttctctgttgcttctgacagacatctaacttaaattgtaaactctaaaggctgccttagaaagtaaatttaaacaactgggtgcagtgacacaagcctgtagtcccagctactcaggagtctggggtgggaggatcacttgagccttgagagttcgaggctgtagtgagctaggattgcgccattgcactccagcctgggtgtcaaaggaagatcccatctccaaaaaaaaataaggaatgatggcacgaaaagggctggtatagttttgcttatttgtttttgacggagtctcactctgccacccaggctggagtgca

SEQ ID NO: 7235 - DNA, 1201 bp, Homo sapiens
ctggagcgagccccagtgcaatactgcccaagcccgggcggggtctctgttctctggcagaggaggtcccttggcagcgggaagcgccctctctttctctcgccgccgctccgagtctgcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgtgaccatcgtgagtgccccccggggacgcgccgcagcgccgacctccgcccgccccgggaggggctgcacccgaatccagccaccccccaagtcttccccagattcccggggaccctctgagagcacactccctgcggggacctgctggcttccgggaggagagggaggtatcccttcggggccacgcgggtctgtcctcctcgggggtctgaggacccttgcgcggtgcgggggaaggctactgtggcaaccattcatggtcccttttagcctctggagaggaggcccctccggggctgggctggaggctggcggcgtggctggggggcggggtaggacttttttcagccctagcatgtttgaggggtgcgtccagaatctggggaaccccagtcctggaagagggaggaagctgggatctcttactgggtcctggctcggagtgtgggggttcgcagctggactgggcactaagctggcatctggactgcgctagctggatcgcccggggagggggcgggagagagtggccgggaatccgggaagtggagttttctggccgggatcgagagggaagggcgggtacggcgctaatgctcccacctctgttggaagctctttgctttgggttgggagggtggacggtttacagcgaggag

SEQ ID NO: 7236 - DNA, 1193 bp, Homo sapiens
ttgatgtgttccaaggctctccaaccaagcaagttatagttcacataacttgctagtttcttacttaagccccaaactgaaatcctgtgtgtgagaaaaccagttttttttttaaatgtctgtttccttcccacatataatttcaagaacagtaatgaagaggtggttcttattttgtaatccatgtccattcaaacaagctgccctcatcgtgggtgaggtgaggtgaggaaaactataactgacataaaacatccacctttctagtcagctgaggcttacagggaagcaaagggatacgggtaatgttttcagatttgtatttaataccaggagttgtttccgctacttaaattcactcttgaaattgtgtactaacctttacctataccttttccttctaaatgagagtttcaaaaattatccaggtgataggggaaggtgaatatgagatattgggggatttgctgataaccaaaggagtgattttctccacagctgacactttcaaaagggaagcttttgatgtgggcttactctctacatctgcaggtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttctttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaattatgttgtttattaaagttgtccaccaagtgtttgagtatctcttctaaaactgttccattattttgtt

SEQ ID NO: 7237 - DNA, 1233 bp, Homo sapiens
tttttcagctagttattggtgtatagaaactattaatttttgtatgctgattttgattttgtatactgcaactttgttaatcagttctaagagtttttggtggagtcttttaagtttttctatatataagatcatctctgcacacagggacaatttgacttcttccttggcaatttggatgccctttatttctttctcatgtttcttattcatgttataatggtactgttagtaccatcttagcaagtaagcagtacctgcactttgttcagtgtcaccccaaatctattatcaatgggtttggtttttcagtggggggaagataaggctgtataactgtcttgatctttagtgatttgaaaagcaaaaaaatatttattatgcttttatctgttttgtcttctaatgaatagaacttagaaatgaaatatttatcttcaattttgtgtacctttaattgacttaaacaatattattggtggcagtcatacaacctttaaaggacagccctaataaaaatataaatgtttaagtgtaggtaattttatgcaccacatttattcattgtaaaaatttgctttttaataggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcaggtagctattaaaaactgagataataaaggtaacatatatgtaacaatgagattacatttatgctttaagaaatttttaatttcctgttttttagagctttgggcactcccaataatgaagtgtggccagaagtggaatctttacaggactataagaatacatttcccaaatggaaaccaggaagcctagcatcccatgtcaaaaacttggatgaaaatggcttggatttgctctcggtaaggagtgcccttgatactgactttcaaattattgatgattctgaatatattcagttctttgttttgcctagaaaataggaagaacactaacatttttgagctaggtgtctgttatgtacattgtattatactagcttcattttagatatcaggaggcactagtggctttgagaggaggatttagcattagtttttgttttttatctgacaggtagctatggatattctgagggagaagccag

SEQ ID NO: 7238 - DNA, 1290 bp, Homo sapiens
tttctggcgcgtaaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttag

SEQ ID NO: 7239 - DNA, 3463 bp, Homo sapiens
ttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttccttttgggtgtgagtaatctgtcactcttcctgaggagcctgtggcctccccagaagactttccaccccatctgtccaaattgaatgataacagtaatgatggcaatgtctgtaattcactaaggacctagtgggtgcccatttggcaaatacctctt

SEQ ID NO: 7240 - DNA, 1111 bp, Homo sapiens
cctgagcgggcctgagtgtgattaaaactgtcatcaaagatgagctttgctgaaacataacactatagtctatgtaaagggttcaggttaaagcttaataaacatatttcctttgctacttcatttataacgtggctgaaagctgtcacagaaggttgccaaaagatacttaatagttgtctgatctcaagaaactagaccattataggtaactctggagccagaatgtcaataatctgtcaggatgactaatcccatttcaatgaatgagaatgacattgttgattggcactgggcttgtgagcttgggtttggaggtggggagaggtgacgcatgtaccacgtatttgccaggactaccaagggacctttttctgctttactccatagtcatatctaatttctaagtgttcattggccccatataggcttcaggaattcctagtactgccttccttggagtttactgtcattggatcgattagcaaagggtaaatgcatgaaactttccatttctctttatgcttgtgtctataatttgggtaagatggcaggtgatggtttggggatctaggctgaggtctcatgagctaagaggattggctgattaggagcacatcatgatacacttgtttcctttcataccttctctgtttctctctctctctctctctctctctctctcttttctaggcaccttgacctacttttgtccttaatcttgccaagcacgtttccccctcggcccttttaccaggtatgttcccccagtaatctctctcatctgttcaggttttttcaatgttatcttcttcattgacccctctctctgaagtgctaccccctccccaggccaatctcaattctctaatcttagtttatttttgcttcatggtgctgctcattactacagaatattatgttcaatagctctttatctatgtgcagattttctatcctcttcactagagtgcaagactttgagagcacagactttgcctgtttattgttgtatcccaatgcctagacgagtgcctgaacatagcaggtgttaggaaatgtttgttgaatgagtgaatggagtgttgaaagtaaggagacttttctaggc

SEQ ID NO: 7241 - DNA, 2964 bp, Homo sapiens
cccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaattgtctgtctaaatgcttctgaagcttttaaagtatctggttctgtcactggccagttatatcaatgcagagtattgtgtacctacttactattttatgagaattgatttttactaagcctgatttgaatgggttgcatttacaccaactgctatttattaatgaaagtggtagcctgctttttaagtaatatgtgttttggcaacaggagagggttttctgagcttttaacaccagtaaccctgaacttcttccaaaatccacaccttttattcccccttttccttgtctccttctaggtgcctcagtcctggcatctcgggaggactctgccattactcatctgttactgattctgaatcttgtgctctagctctacagcccagtgaagaagcaatatatctttaattcagggcttgcc

SEQ ID NO: 7242 - DNA, 1202 bp, Homo sapiens
gtcgaactgaagtgattagaaatatcaacatctctttcaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgactttttccagagtactccctctgttgacaagcatgacactgggggcagagaagagcccgaagtcagtcatcctgggtataaatatgagttctgccacttactgtatgaccttagaaagttattttaattaatttgaagtcttggttttaatagctggctgctattgtcggttggttaaggctgacatattcccaaccctttaagttactggaaagatgtagctctccactgacacctgcaggatattg

SEQ ID NO: 7243 - DNA, 1099 bp, Homo sapiens
agattatttaactgattaaagagtcccttgaaattgatttttcaagtgttagaaggttagccatgtaaaggtatttatacttacctcaaaaaaggatcaataaatgtttatgaaatccatacatatgaatggtttggcttttggtaaaaaaaaaaaaaaaaaaaaaataccctgttcctcatccatgtgctatacttttgaaacagttataaggaaggaaaccagatagatggaaacttcatagtggaaggaggtggtgagaaggaagtagtaaactgttaagagcatttcagcattgctgtattgttttaatattctttggctttccaaattattgcagaatgttattttttaactgaagaagctcattcagttgttccattgattctgagaagaaaagatttgttattacaaataaaattgaaatttaactgaacaggatttaccatttccttacttaaattggagtgtctattttaattcatatttcagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggtatatacaaacttatttctaacatattttttactgactgaaagaactagttttgaaaaaaaaattgctcttagtatagatataaatggaagaagatgcaaataagagaattacctgcaccagtctgcctttattagaatgacatctcagtgcttgcagaaatctcacataatttccttaagattttaaattgttttaacatgagccagatttctatttgtatactgtctccgatttaatagatcgaaatctgatttttaagccctcctggtgacatgtatacctctgaatagtgaggcttaaaagcatggggggacacagtatacagactttttatcaggctttaagcatacctcctacctttcttcagcatgctagcatatcaggggcctgtctaaagaaagatggtatgtaatttatataactgttg

SEQ ID NO: 7244 - DNA, 1133 bp, Homo sapiens
aacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaa

SEQ ID NO: 7245 - DNA, 1079 bp, Homo sapiens
aggatgtcagtgagtcagaatatagaaaaatccttaagcatgtagtcagatagctgtatgtctcgatgaagaggttgctgtcaccttatattcagtcatgagacaggcagcatattgatgtataaaattaactttattagacttctacacctccaagcttaatggtgcaaccttgtttatagcttagagtgaaatggggagtgcatttgggttttgaaatgtaattatctgccaattgtcagtaaattgttacattggaaaagttaaattttttgatgacaaaaattgacaaatgaatttggttataatttctatttctgatgaaatgtgttttaggaataatattctgtttttactgttagcaatatacttttgctgttagaatcaggaaatcatataaactaggttctgtatatggcatttatagtaaatttaaggcactgatttcaagatctgtttttagtaagatgacaataaattatttaatactgattatgatatggaaaaatctgtttaattatgttattatttgtctgaatatttctcataagatgtatttagaaaaagttacaagtttcccaaagaaactgctatttgaatgaactaataaaccaccaagatcatacccagttctactgtgacacggtgtttagctttttctagtaactgaaatctaggtgttttttttgttttgttttgttaatagaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggagtaagttcaccagtgcttaaaaattataaataccttgttcataatttttcttaatttgccttttaaatagttaattttaagttaacacatatcttaagattaggctttgttctgttttgatatttcttcaaatttattatagtattagagtacatgcaaagatgtcttttactttcataatagaatgatattgcatagaa

SEQ ID NO: 7246 - DNA, 1187 bp, Homo sapiens
caactgctttttgaaaattactttctatttaaaaataaaaagtaatttaagaattgttggcatctgtattcttgattaatacccttgtttttcaagatgtacttgcagtaaatatatttgctttttaattcttggttagcagttgaaatggtgagtttcagaaggttaaaaaggtaattttgtcttaagtgaataaaacaaattattataacagcatcttataaattagggatcccaagctgatttctaaacatttctactgagtaaagaaattataccaaatatttgattagctcattctatttaatttttgtttttgttttgtatcatggattaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacgtatgtatgttattagggatgaatttctgtaaaatatttttccttaggctagtagaaaccaggtagtaaacaattactgttaattggttatttttagagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggaggtaggacccacttttttttttaagggaatgaaaacaaataaaacaaaaatacattttaaaatatgcttatttagtatgaaaaataagactcttctttctttaatcctacagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagat

SEQ ID NO: 7247 - DNA, 1115 bp, Homo sapiens
ggacatttccagggtggaatccaagtcaaaaatgaaaaaaacagaccatctttgaaatctctgaaaactgataacaggccagaaaaatccaaatataagccactttggggaaaagtattttaccttgacttaccttctgtcaccatatctgaaaaactgcaaaaggacattaaggatctgggagggcgagttgaagaatttctcagcaaagatatcagttatcttatttcaaataaaaaggaagctaaatttgcacaaaccttgggtcgaatttctcctgtaccaagtccagaatctgcaaatactgcagaaaccacttcacctcatcccagccatgatggaagttcatttaagtcaccagacacagtgtgtttaagcagaggaaaattattagttgaaaaagctatcaaggaccatgattttattccttcatatagtatattatcaaatgccttgtcatggggagtaaaaattcttcatattgatgacattagatactacattgaacaaaagaaaaaagttgcattcactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaaactcaattcaactccagttgaaagagaagaagaaaaaaggatattgtgaatgttgcttgcagaaatatgaagatctagaaactaataaaatacagtgttggatccctttctcctgtttctgcaagtgtcctgaaaaagactgaacgaaaggaaaaagtggaattgcaacatatttctcagaaagattgccgggaagatgatataacggtgatagagcagaatttcctgtataaagagacccaggaaactgaaaaaaacttctgtttatttcagagcccatcccccacccttcaaatgacttgagagggc

SEQ ID NO: 7248 - DNA, 1105 bp, Homo sapiens
gaacaaatagatttgcaatatattcaggaggaagagtcaataggtcttaatcaccaattaggagtgtggggatggagtggaatggatgactgtaggcttctggcttgggtgattttgtggatagttgagccactaattaagaagagaataggaaatagcaacaaatttgaggacttcctctgcctggggaacaattctcttatagattgttatgacggaataaggtataagattatttaatgaggtatttagatgacaaacttgcttgggaagaaatgtgatagaacagagagatggtgtcctaataatgaggggaagaacatccagaaccctgaatttaggaaaacagtgtataggagtatttagttacatgaatacatattaagagatttactaaatagcagggatctaaaagttttaccagagcttatgaacagacaagaatttggtttaaactgttctagatatgcctttgaaatgttattgttttatcagttgttagattaaatcatgcttaaagtgctagttttaaaatgaaatctgattaaaacaatttaacacaggtaaattaatttttacaaacaagaaagaatttgtggtcatttggtaataagtatttcctgctcagattgtatcagtcacattcatttttataagagattgtatcagtcacattcatttttataagacctctgcctatgaataggatatgtgagtcacaactatggaaaattaggcctctgaaatgctgaaataatacaaagggttgttttgccaaatgcttgacactaagcaaagacgaaaaagctgtttgatgtgcagatcatcttctgctcttattcttgccatcacatctaaaagttttgggaactgtttgactctctgttagtattaatataaacagatctataactgctatccaggcagctaaatgtctgtcttattcttgattatcttttgcatttaatccaagataaaatattaaacctcttgatttaatgtcacaaaccagtagtactcacaaagctgaattacagactgtcaacaggtggataattgctgaacatttacagatgttagttcacatggaattgtttagaattac

SEQ ID NO: 7249 - DNA, 2285 bp, Homo sapiens
tatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttacattgtttaaggtatataatttttaagtcttacagaatttgtacagcttcgaatgctatagtattagatgctttctttctcatactacatttcttcatttggtttattacattagtctcaccagaccagtacttgcaaaaccctgatggtgctgatcgtagcaggtgatgcatcaccaccaagcatttcaaaaactatttcagccattctaggctagaggcctgagcaagtaaaacatggagaaaaggcagggcagggcctaagaaggatgtgacatgtcctatgataaaggaccaggagtttgggatttgagagagaacaggaagtggtggatagtgaaaatccatctgatgcaaaggctgggttaactgaaaatctgttctgggatgctaggtctttcaagtctgaagactgcagaccacatttggtatcaactttctgaggctgacctgagaacctacttaagc

SEQ ID NO: 7250 - DNA, 1150 bp, Homo sapiens
tttctgatttaaaaaaaataacagaaacgaagcaaatagaaaaagaaatcataatcaaaactgcattttgtatttggtttgtcaactagttctgaatggcttttccaaaaaagggctctcaaaatgttttggcaatggcaaaatactcacttatcaaacatttattaagcacttcctttgtgccagtattaagattatacttttaaagaaaaaatattgtgtggatgagcaattagaatgtgtctcaaaaaacttgtcttccacaaattaggaagtaagataacacgttagagcagatgttaaagtgaagctctgctgtagcgactgtaccaaatattacttgctactgtatctttttgttttgaagtggttgactgaatgatttctttcttggcagtatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaa

SEQ ID NO: 7251 - DNA, 1213 bp, Homo sapiens
agggctgggattacaggcgtgagccaccatgcctggcctcttttttttttttttctatcattcttgtattgttacagtagagatatatttttcaagacaggttttcctcaagtgtgaagatggaaaaatccagtagagacaggaagctggtgatgcaggcatgtatcagaatgcagttcagaatggctttgccaaaataatgctataggaagttttccatattgaaaggaacactaatagtagctctgaaaattatattccatctacattccatttcctacagaattctcctggggctgcatgctcaggtggaaaatcaggattcactaaggccgtgtgggattttaggagagacactgacatttcctttagtgctccatggtgagaaactggatctggaacatacctggttcatttggatttcatggtataaatctaacgtctgaatcttaaaaagtggcttcctcaattgtactgatggacatgttcttccttgccatatggaaattgaaacacgtttgtcattttgacaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtagggaagatgacaagccagttggccacctcacagcatgaagctatagacagtgccttcaagaaggtctttaaaaaatatacgcaatgttttttcttcttttttgtatttgttattgatatagttgtacatgttttagggtatatgcaatattttgatacatgtatacaatgtgtaatgatcaaatcaggataactgagatatccatcactcaaacatttatcttttttgtgtattgggaacattacagtttttctcttctagctattttgaaatatacaagttattattaactataatttttccactgtgctatcaagtactagaacttatttcttctatctaactgtgtgtttttacccattaaccaacctctcttcattcccttctcccatctatccttcccagcctgtggtaaccaccattccactcaccacctccatgagatcatttccttt

SEQ ID NO: 7252 - DNA, 1105 bp, Homo sapiens
gagccattgtcgcctggctgcaatcttgttttttatacttaatccacatcccacctccccaacccagaatattttgaggctaattccatacatatttacatatatatacatctctcaaagaaaataacttattttccattcttcatatatctattcctataaataatgttcttgggggaaaaagttttcacatttaatttttagtgttaccaatttgagcattaatattttcttcctactagggactggtttggctgaaagacaaagaagcaacacattgtaaactttgtgaaaaggaattctcactctctaagagaaaggtaagggagataagaagtgagtccaaaaatttggagtgcaaaaatgctaattttatttaaagtgtttttttccctctgatttttctgtttaatagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacagattttcattatctttgtaagatttcaactatatttatttgccctttcttctccccctctccctttgcctcttgcattagacagggccaatattttgtcctacaaaatttcctct

SEQ ID NO: 7253 - DNA, 1072 bp, Homo sapiens
gaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaggtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaa

SEQ ID NO: 7254 - DNA, 1184 bp, Homo sapiens
aaagtgaatacgaccaccactgaggtccagggccaaataactaacagaaatattatgatgaactttgcagacatccagcccagagtcagggaacacagccctcatctggtttctctctttggtgttgagggcggttttccgttgctggcgacctagacattgctcaatggtgtcatctctgacctggcaccttcttcatacatttataaacatgcaatttagagatcctaaaaactttttctagagctcccctgggaaaaaagttaatgacaaaatcttgacacctctctacgtcttcttcggagacagagaagttgagagaggtggagaacgagggggagggggagggggtcgagagggagtcgaggagggattccagctccagtttgggtaaatccagctcgcgttttgtctctcgctcaactgtgcagggtccagcgaaggcagagccccagcttcactccctgaggtctgtcctggggagacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcggtgagttggggccggggcagagggcaggggtgcggggagcgaggactccgacgccgaggcccgaggggggtccgggaggcggcgctcggcgcgggctggatgtggccggggctctgcgtccttggctctcccgctgcctcaggggtgggctcgttccccgcctcgaccccccaccccgggacgctcgggacgcttttgttgccggagataaacaatgcccccggccggaggtatcggccacccgctccggaggccccgccacagcgccgggttgggggcagcgggggcgcctggggctctgaccccgggctgcggtgga

SEQ ID NO: 7255 - DNA, 2582 bp, Homo sapiens
gctggtcttgaactcctggcctcaagtcatcttcctgcctcagtctcctaaaatgctgggatcacaggcatgaaacactgctcctggtccttacttttaactggccgggcacgctggttcacacctgtaatcccagcactaggggaggccaaggtgggtggatggcttgagcccagttagagaccagccagggcaacatggcgaaaacatgtctctacaaaaaatacaaaaattagccaggtgtgatggtgtgagcctgcagtcctagctacttggggggctgaagtgggaagattgcttgagcctgggtaggtccaggctgtgctgagctgtgatcatgcctctgcactccagcctgggcaacagaatgagaccctgtctcaaaaaaataaaataaaacaattagtagtgaatattctatttcaaataggggaatgcataggaaaaagactcacttcagtgtattctgttgttatttcagaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggtaagcaaacagtcaaggggctgggagacagctgacacttggtatagtgatctatatgcagagac

SEQ ID NO: 7256 - DNA, 2988 bp, Homo sapiens
tcttgctcaggctggtcttgaattcctgggctcaagcgatcctcccatcttgtcctcccaaagtgctgcgattacaggtgtgagtcactatgcctagcctagttgtcttttctttttgtatattatgtccttttggtattttatgacttcgctgaatgtgtgaaaagcaaaaataatattttaggctgtatccacaggggctttacatttagttgttattaaattttaatcttctatggctgttattcagatatttaagtagatgacataagtaatttctgtattttacaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttggtgagtacttgtgtgcatgtgttcttatttcacctgcacaaattacctcaatcatgactgaagcaaattctgattcatcttttttgtgtgatattttttccccattcttattctaactaagatggattaagtaaatctataaccatttttctgtgggaacttttggttctgccacaagaatggaaaattcagctcataatttggaaaaacaaacttggaaaaggtaaacccgctcaagtggaaaaataggctgatatatctctcaatgttgaatgtctgtcaatttatcgtgcgtagcataagaatgaatttcgtaggccaggcgcaatggctcttgcctgtaatcccaacattttgggaggccgagtcagatggatcacttgaggtca

SEQ ID NO: 7257 - DNA, 1124 bp, Homo sapiens
cgggtgcctatagtcccagctacttgggaggctgaggcagaatggtgtgaacccgggaggcggagcttgcagtgagccgagatcgcgccactgcactccagcctgggcgacagagcaagactctgtctcaaaaaaaaaaggggattgctcaattttaataggattctaagggcaacctttaacatttattgttcttggataacttttagtattacacctcaattaatacagattttttttttaagcaggagataggagtataaatatgacccacatcttaaaatattttttttctcctctgattttcagaggaagaaagaattcgttaggggcaggaagaaaggaacattaaaagttaaatttcatgggctgttgtccttgcctttaattatcaaatcttaccaaaaccttgtcaagattcatggttctgaattgagggggaacaaaaagtataaaagtagcttctcctgtcccctatgcaattctgtaaagctttgggtctaataatcttattccttccacagatcgagttatacaaaaagacaaaggcccatattatacacaccttggggcaggaccaagtgttgctgctgtcagggaaatcatggagaataggtgaggaaatacgcttccctgttaaaatcattcttactgtggatctgactcaacggagataaatcatctctaagaacaaacgccgtgattgaaaaatgatcaggagtatgagttggatgtttcttagggcccaacaaaagaggggtgtcctcgtgtccctactgagccacccatcatacaagctgttgggcacataaaagcacccacaaagcaagactagttgtctttgataaactcagaagtactttttatatatcgcataatggtagaaataggtcaaattaccacccttgacactgcataccctacattcccattgcttgtctggcactcagcctattttttaaagagtgatctttgaggataagtgagtaggactggttaacaaattaaaatacctgccacacaaaagcaaatgtttaacaagagtaaattacgaagagtgtctaatttttgaacttctgtacatctatatcttatatacattaagatgttcaaagccaaagcct

SEQ ID NO: 7258 - DNA, 1263 bp, Homo sapiens
tacatttgttcccttgtgacatttgtggaatttcagtgcagttttctaccgggccctctcttgtctgttgtgcaaactataacagcagtgaaataaaacacagactgccttgtactacttctacaaataataaccacgtgtcacagatttttgttctgcctgttgtttgttagtcatataggttcaggtactcttgtgatgagtctcatggagggaactgttgaggcagtggaaagtcctacagggttttatcccttgagaagtagtaactttaaaaaaactaaaatatggccgggcatggaggcacatgtctgtaatcccagatctttgggaggccaaggaaggaggattgcttgaagctaggagtttgagaccagccttggtaacatagttagaccccgtctgtagaacagattttataaattaagtaaataaactaaaatataatcatggagaacatcaaaaggaatatccattgcattcaaatttggcatacttgtcttccatagatgaatgtattctgttttttcaggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaagtaattaaatctgttttatactgccttaccattcagatctctattacatattggtaaaattgttaattagctaccaactatgtatattatatgggagaataggatttgagtattgtggaattaaaaagaatgaacatttctgtaaagagagagtctctattttatagtgagttaaggttactttaaatcattctcctttggaatattacttcactgtgaccaggtgcagtggctcatgcctgtaatcccagcactttgggaggccgaggcaggaggatcatgaggtcagaagatcaagactatcctggctaatatgtctccactataaatacaaaaaattagccgggcgtggtggcgggcgcctacagtcccagctactcaggaggctgaggcaggagaatggtgtgaatccgggaggcggagcttgcagtgcgctgagattgtgccactgcactccagcctgggtgacagagcgagactccatctcaaaaaaaaaaaacaaaaaagaaaagaatatta

SEQ ID NO: 7259 - DNA, 1849 bp, Homo sapiens
tatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcataaaactggtcatctaacattatttctacccctctattatgttttactgtaatgatcaccttttcttatacctctcttataacacttaaattgggttttaaatctgcgtttgttcatagtatgatcattgaattcactgatacatgacctcctaatagcccactcagttcataatatgctacaaacttaccaattttaatgagagaataattcctgcctattgcagaatcgtacaaaatatcatgctgcccttgatattccatttcttttttcttttttcttctttttttttttttttttgtagagactgtctcactatgttgcccaggctggtctcaaactcttggccccaagagatcctcctgcttcagcctcctaaagtgcaaggatgataggcatgagccactccacctggcctgaaattccatttctaatggctcttca

SEQ ID NO: 7260 - DNA, 2471 bp, Homo sapiens
cacctcacaatcaaaatttaatgtatttgtcatattgaaatgcagggttttttgaaggaaacatggtaggtaaacattttagttcccaactcctgatcgttaaaatgcaaaattgggcctggtgtggtggctcacgcctgtaatcccagcactttgggagaccaaggcgggtggatcacgaggtcaggagttcaagaccagcctggcctagatggtgaaatccccgtctctactaaaaatacaaaaattagccgggcatggtggcagacgcctgtaaccccagctacttggtaggctgaggcagagaattgcttgaacccaggaggcggaggttgcattgagccgagattgtgccactggactccagcctgggtgacagagtgagactccatctcaaaaaaaaaaaaaaagcaaaattgttggcatctctaagacagagcaagactccctctctaagagatagtagtgtctcccacttaattgaattcgttttgttttgtttgctttgctttgattcttgccacgtaaaatctgtgggtcttgacccagagatttgctcagacagttaagaaaaataataagatgtatttgtaaatttttacataatgaaaaatgagatgtatttgtaaaattttaaaataacctctttataaatacgtttataaatataaagaggtaggatgttttggctaattagcacattctgggtcatacacacacacacacaaacaggccaaacactctagatagtcaaataaattccccttttggtgattcagttcagtaatggtgattcagttcagtaactgcctatcctcatcaatgcttgtttgtgatgatgaaatagttgacaaccgggactttacaaaaatagctcctgaaaaaaattaaatattttattgcaatatatgttcatattttttttaacttttatgaaataacattgtgataggtgctttaagaaaaatatttttccagaagtggtttatagtataaactaagggcagtttttacattgtgatgtgtgggtggatggtcatatttagttaggttattaagaaatcatgaagtgttccctaacaagaaacttgcaaagctatttggcaggaagaaaatcattaacttctagtttatttattttttttctcatgctatacgcttaattaccaagtaaattcacttgcataccattaccttaattcaaaggagaagccagaatgtttatcattggtgggagtaaaatatacacagattctttaccatggtgaaatagaataatactgaattcccaatacagaaatactaatttcataagctaatattcctatcttttagctgacttctttctctcttcaggatatatttactatttattatttacctttgaatttttgatttgggggatttttacctattgccatcctactatcttaagtatcctgtacaatgaaatatcttagcaaggaaacacttttaaaacttcacaaatatccaatttcattcttaacatatgggggaagcagtaaaagaaaaagcacttcaccacgtagaagagaaagtgatcattttaattaagataatttcaattcattatcaacatttaatcctctgcaaacaagggaacacttactagcagtacttgaagacttgtgagttggaattgcatgttacttgaaagatctaattaagctaaattttggtgcacagcaggttgtacatgatttcatgtttatgtagcaaaatgcattgaaatgtattagtgttgaaacatacatgtaaaggtagttgtggaaattgttatattttccttgtgtgtcatttatttagagcataaaggttttttttattcagcctaactgaataaggctaaatgaatactgtaattgaaaatatattttaaatctttgtcatgagtttttttaaaaaaaactattgcaaattgtatcattcctgattacacagaactttgtgggtggttttaaataaattttatacttctattttgcacctgatagtctaatttttctttccttctaaaaatcacatttaaaagttttaatattcaataaaattcacacattttaactacaaaggactataagatttaatatttggagatgactaaatgtatgcatgtgctcaccataaaaccaaaatggctagcatttgtgaaatcctcattatgtgccagaaaccttacattttatgtaaattatgtaattcccatggtgattctattaaggactcttatcagcctcattacatagatctattctgaggcttgaagttattaagttcacagccctagtaattggcagagctgttactctactcatgtccttacttggctttataattgtttcaataaacttaatacttttccttaagtctgctaaatttaaatttaattctgaatgcagtttgccaatatattttactttttttactttttttttgagacagtctcacac

SEQ ID NO: 7261 - DNA, 1196 bp, Homo sapiens
acctctgttgcccaggttcaagcgattctcctgcctcagcctcccgagtagctgggattacaggcgcccaccactgcgcctggttaatttttgtagttttagtaaagatggtgtttcaccatgttggccaggctggtcttaaactcctgatctcatgatccacccaccttggcctcccaaagtgctgggattacaggcgtgacccaccacgcccggctgcatatttcttttatgtcactttgtacactagactgtcacttcaaatatttactataattgggtgctttaaattttgttgatatttttcacttctaatgtttttcccactagattaggagtgccatgagtatctttatcattattacttagcatattactttgtacttgtaggtatttaacaaatattttagagtaacaatacagttaactgtggtaccccacacagataaaagtacttactaaaaacccagcaaatcttgtcattgttttttatagttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaaggtaatccacaaattcaagaagctgataaaaaagaccaaaggaagggtggtaactctgtctcctgggttcaagtgactctcatgcctcagccaccctagtaactgggattacaggcacccaccaccacgcctggcctcgtatttttagtagagatggggttttgccatattgcccaggctggtctcaaactcccagccccaggtgatccgactgcctcaccctcccaaagtgctgggattagaggcatgagccactgcgcctggcctggtgactaagtagttttctaagagattaataaagccttgggaaattggaatggggctcattttatctagaaacttggattaaaaaaaaaaagtcattactctgggattaaagctggtgaggaaaaaaaaagtcatgatttatcatattaccacaatggggaaaacttggaaaagtaaagaaaaataccatcttctgtcatcttgatgtggtctgcttttggtgtattcctgatgttttgcattttattg

SEQ ID NO: 7262 - DNA, 1203 bp, Homo sapiens
tggaacttaaatctatctgagttatgtaaacataaatcacacttaaaatttaaacattagagggcagcagagaaatctagtgctttgtgtttaagcttaaaagtgttgaagtttaaaatttcacctttgattctgataatctagatgaattaatttcactgaggaacagacctgtatattaatctactacagattgggtttttaagtaaatgaaaaggcaaaacatacagaaatttgttggttatttggtttcctgtagaaagctagggagtggcatttcctttcctgcattttcctggttgtcagaaaataaagaagttagatgctctttagagaaaggggagaggcatggggagatgggcagatcatgttgctttctgctttactggcttatttaggtttttttctgtcagtggtggctgcagacagctcttatcaggcttgagtagttgtttccaggagcaagacattagaacattagtgttgtgctcactgatcattgtgttgtgattttagtttccagcaaagctttactaaatagatgttttttttcttcttacataagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggttggtccttccccttatgccagcaaaactggggatatcaacaaatcttcaccttgggcatatctgctcttggtctgattttcattcattcagtgaataccagtttagtttagtttagaaatgagaggaagctacttttttttttttttttttaattgaggcagagtctcattctgttacccaggctggagtgcagtggtgtgatctgggctctctgcctcctgagttcaagtgattctcccacctcagtctcccgagtagctgggattacaagtgagcaccaccattcctggttaattttgttttttctttatttttttgagagggggtctcgcttcttcgcccaggctggactgcaatggtgtgatcttggctcactgaaacctccgcttcttgggttcaagcagttctcctgcctcagcctcccaagtagctgcgattacaggcacgtgccagcatgcccagctaatttttgtatttttagtaga

SEQ ID NO: 7263 - DNA, 2586 bp, Homo sapiens
agaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgattttagtggcttttgttttctaaaatgaaaatagcttgaaatatttattataaaaataataaaagctagatataaaaatctaaagagaaaaaaaaccagtcacccttatctaatattttagtgagcagtcttccacatgttcatttataaaattggaattatttgattttgtgtattgcttttcccccctcaacatgttgtgcacaattttgtacaggcttacatggacatttttgatgacatgttttcttgtatggatatgccactacacatttaaccagtactcgatgtccatgttggttatttctaatttttcaccattataaacaaccctaaagttaatatcctcacatatgtgtt

SEQ ID NO: 7264 - DNA, 1166 bp, Homo sapiens
cagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaacttctgtttcctttttgttttcttgtgagcactgatacctcaatacattgatacctcaatacctttgaggtattttttgatacctcaaagatactagcttatttgaagctagagaagaatatttcttcaataacattgcacagttagaaaacattaaaatatcattcatgggccaggcaccgtgtctcatgcctgtaatcccggcactttgggaggctgaggcaggcggatcacaaggtcaggagatcgagaccatcctggctaacacggtgaaaccccgtctct

SEQ ID NO: 7265 - DNA, 1977 bp, Homo sapiens
ctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctcttctcattgttagatttattgtcgaggataggattgttcaatagtttaggaagctgtaactgtgataatgaatttttataaatattactggtttcaattttaaatagatatataatgcttttaataggctggcttaaaactgtcatatacaggatgcctatccgttttgctcaagactttttgtagcataaccaatttgaaaaaaattcaaatttaatatttggtgatttcagtcaaaagtcagccagc

SEQ ID NO: 7266 - DNA, 1117 bp, Homo sapiens
tgtatagtccacatcattccctaaatgtctgggacctggctcttaaaagctcagcagccaagaattatcttagcattttgtttctttttccaatttggctctggctttcttttcccagggctgtggaagccggggtctggttgggaagtggggaagggggccagggatttctcttgctcccttttaaaataggtctggctgcgcagttggcatccagttagattggcaagccatgtggcattactgtccccacatccacttgctttcttctggagtgaactggatattgtgagcaggtttctccccaccctatctttgcccccagagaagcccattgtgtggatgatcgggagatggaaatgagtctgggcccctccccaagcccagtgtgatctgggaggagccacttggcccctatgggcttctgcttcatccctgtcctggagcaatgcccagggccttggggtgctggaggcctcccagccctcatccagccccatccattcttctttgcaggccatcctgatcacctggacaaagcgatttaaagcgagcggagtggaaggagcagatgtggtcaaactgcttaacaaagccatcaaaaagcgaggggtaatttctcctgggccctctgcctcagccatgcaggggtgtggggagcagggctgcattctaaaacagaccagtgcccttcctggggggcagtagtgccaaagcctgaagacccaggcaggggagagttgagggctcacagtgtggaatgatgaggatggggatggtgcaaagcccagctctcggaggtgctgcctggagcacccaggcctggagcagggggtcacctcctgacaggagtgctgggctattcagggagtgggtgtcacggatgcagcctgctgtgcttagaacaagggcagaggagcccgccttatcggggacgtggacctcctgtggaggtttgcagaggaatgtagctccatgagtaaaatccccactacccaaagactcttaagccaggtaattaaggaaactgtgaggttttcatcatttaatcaccatgctctgatctagttaatttgagtaccagctgtaatgaaaccagtaccactcacaaaagcag

SEQ ID NO: 7267 - DNA, 1215 bp, Homo sapiens
aagaaatcatggtgcatccctagagggaatactgcagcagctgtttccaatcctgttctcagataaggctgtgggaaattgctcaatgcatgaaacaggaaagagaaagaaaatcacatatcaaggataatcccattttgcatatcatgagaagcataccagctaggaaaaataaactggaaggaaatatattaaaatgttaatagcattttcctagatgttgagatagtgaatggtttagattttccaatttttattttgctagatttgccaaattctccacagtttaacatgtaacacttgcccttgactctgtctgtggatgagtacagtgattgggggcggggggcgtcctttggacgtggtctccaggctgctcttgtgggtcctgcttcatccagccctctggctcttgtcccccacagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacagtgagtgggccttccagttgggatgcgcagagcttgctgggatccctttgggttagggggtatcagggtgtggtttacgctggggaaatgccctgcgggagcccagccaggctgaaggctgtgcgttcaggagctggggattgtctaggacaaggtaatgaacagtttgtagggtttgactgggatccttagggagacagagaagtggcttcacttggccagctcacaccagtggcatgatgtgaccctcaccccactcctcctggtcccccttaggtgggggctaggcagtgggagaggaggtgagggtgggcgtgggctcactcataagcctggtgagctgtagccaggccagaggctctgttgggtaagtggggagaggatattaagaaaggggaggagctgggtgcagtggttcacacctgtaatccagcactttgggaggcctaggtgggaggactgcttcagtccaggagtttgagaccagcctaggcaacatagtgagaccttgtctgtacaaaaaaattttgaaaattagccagggatggtggtgaat

SEQ ID NO: 7268 - DNA, 1190 bp, Homo sapiens
tagccaggtgtggtggtgcatgcctgtaatcccagctactcaggaggctgaggcaggagaatcgcttgaacctgggaggcggaggttgcagtgagctgagatcgcgccattgcactccagcctgggtgacagagcgagactccgtctcaaaaaaaaaaaaaaaaaaaaaaagaaaggagtgatgatgagtattaaaaatgctggccctagagccatgccctgtagtccaacctgcctcaaccacttcctctctcctctgtcctgggcctgatgtgaggaatatagactggcatgttctgtgctctgagagcttgtgacttggttgttgggattcttatgggtggcatgggggattgctgagaaaggagggtgtgaccctgggtggctgtaggaagggcaggatgcagcctagagaggttgattcctggctggtgcgtcaacccaatgattcattcatctctctctgtcttcacattccagagcttcttcaacaggggccatggtgctcccccagggggtcctggcccccgccagcagcaggcaggtgccaggctgggtgctgctcagtcccccttcaatgacctcaaccggcagctggtgaacatgggctttccgcagtggcatcttggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccaagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttt

SEQ ID NO: 7269 - DNA, 2456 bp, Homo sapiens
gctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaatacgctatttccttttttttttttcattggtttgttctgagctctgagtttgaacaatgccgtttatttggggaggcaaccaaaagttccctgcatagaggaagagacatttagggtgcgtgtgagatacttgaattttgccaccaggagggggaaaaaggctggggtactagaagtaatagatttagtactacttgagagatttggaacatgctgtggacccagggttgttggtcatctctgcaacaggatggggatggcagatgtttgagcaaaatctatattaacatgctagcaaggactagttctagtttagctgtgtttcactcattttacacagaattagaattggccaggtgtggtggctcacgctgtaatcctagcactttgggaggctgaggtgggtggattgtctgagctcaggagtttgagaccagcctgg

SEQ ID NO: 7270 - DNA, 1260 bp, Homo sapiens
tggtggctcacacctgtcatcccagcactttgggaggctgaggcgggcggatcacttgagcccaggagttcgagaccagcctggccaacatggagaaaccatgtctctacaaaaaaaaaatacaaaaatttgctagatgtggtggcacacgtctgtaataccagctgctggggagactgaggcacgagaattgcttgaacctggaagatggaggttgcagtgagccatgattgctgccactgcactgcaatctgggcaagagagtgagaccctgtctcgaaattaaaaaaaaaagtttgaaaatcacactatgcaattagcatgaagtgtaaggaagcccaaaagaaaacacctgcatttgctgtagagaaattttgtatgtatgcctgttaattttcaggtaattcatagtaggattcattaaagcaagtatattagtctttgttatatgttaggtgtatttttgattctcaacaggaattctaatttgtttttcttttctctgaatacagtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaacttggcttaggatatttttattttaatctgaagccaacattaagtaggtatgggtattttttggtgtttgttttctgttgatagtcttataattcaaatttataattattagacgaagaaatcgcttatatttatagtactcttgatactatgctctagtacataagtcctagcataccattctaaagcaaaagtttttaaatttatatcatattagcagaaagcacaatgttgctcaccctttgaagttatatattaatagttatttttttacttcttcagtcaactaattggacgcttaagtcatttatattatattctaagttatcagctgaacaaaccagtttgaatgccagcccatcttcttactagctctgtaatcttaagtcagtttac

SEQ ID NO: 7271 - DNA, 1195 bp, Homo sapiens
caagcgattctcctgcctcagcctcccaagtagctgggattacaggcatgcaccaccacgcctggctcatttttgtatttttagtagatacagtgtttcaccatgttggctaggctggtctcaaactcctgacctcaggtgatccactctcctcagcctcccaaagtgctggaattacaggcatgagccatcatacccagcctaaaaccacacatctttaaagtaaacgtttgggtctatatttgtgtttccctattgtctcagttattgagtagttggcttttgcttgttttaaataggatcattatctgttttaaagcttaaatttagtttagcattagatgtgtagtaggagctacagcatttaattgaaactcttgtgtgtagttaagattcttaaatgcgaataaagaactaaaacaatgagaaaaaagtagctgaagagtcataggatgttatctgttattctcaacatgatccattttgtcagtatgtataggaatgatatacactgtcttatatttttagacttgggaagacccagggcacaatgataaacatactggctgttgtggtgacaatgacccaattgatgtgtgtgaaattggaagcaaggtaatgaaatgtgacatttttttctttagtgttgagatattaatgaagtataccaaatttcatactttaaaaaatactgtgaataaaatgcatgaatattagtgaaataatgatgtctctttggtattaaaggcttcttgcattttaagcatttgtatattataatttttacatttaaatctagtctggaaaaaaatgtgtctatgtatgtatgattgaacatatatctagaagaactggacatgttctgcattgctttagaagatggataattagtcaataggtgaaaggtaccaggagggaaattccctctcaaaacatggcaaatcttgcctaacaatttagaatgatcagtaaattgacccgaaccaaataacctcatgagttggagatccatggtagtaactcctccatcaagtagggttgttctaagattctgattatagttatttctttatgtctctctcaggtgcagagaaatagtaaacaactaaaaacaaagttatcattttgttttttaagtcataaagtttttgagtcatcgtatgacttgcttaactcatgacttttataaaataaa

SEQ ID NO: 7272 - DNA, 1108 bp, Homo sapiens
aacaagatttttatgggaaataaatttgagatgcatgagtggcctttaaagctttagtaagtggagaacaggcagctctgaaacaagacccaagtgaatcagaaggacagccaccctaaagggacctccccaaagcggccccaacctggcgctggaaagacggggaggctctcagcatccaggcagctgccaggatcaactcagtcatcctcttgtttccgaatagagctgccacgtgatcttcctccaccctctgagccattctcaggaagagaaggagggaggtctgggatctcaacagggcatagaggctgagagggacaaggatacttctgtctgctttctgatgccaaccactgggaggtggtacctgaccttggtgctcactggtagctaaatgccctcacgtttcaggtctgtgtggcacgtggatggcttttgttgccaccttgagcacacggccctccagtctatgtgtgtgacccttctctgccctccacctccaccagcatcgggcgtggtgtgtggcatacagcaggtactcagctgggtgggagcattatgtagagcaggaattccaaagcctcgaagctcctctgaaataagtgagacatgatagggcagagtttttcaagttgcgtactatgaacctgctagtgaattgttaagtcaagtcagtgggttgagaccagcaattttttaatgcagtaaaatagaaaatgtcagagtacatcatcacatataaaatggtaattactatgttgtaacttttaatttcagttttactatgtgcatgcacagatctatctatctatctatctatctatctatctatctatctatctatctatctcctgggacatgatgaaaaatggtatttcttactcttagtcatgacgaaaaaatattgaaagccactcttatgagttgtcctgcagagatttgggggtctgttctcagccaactcagtcacccgtcctccctagctcatgccccaaccacattatacagccttcctcctctcatccctccccttcacctgccccgcatggcccgtgctctcagtctggaagtcctttctcatgtcttaccattttctctgcctgtg

SEQ ID NO: 7273 - DNA, 1376 bp, Homo sapiens
tacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgctctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaa

SEQ ID NO: 7274 - DNA, 1276 bp, Homo sapiens
agccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagttctcctgggccagctggtgcctgtgaaggcagaggcaggaactcatccaagaggaccggccatgttgggttacagaagacatccctgcgtcagtctgcttcggcagacacagcctgagtttgttaaagttggtgacaatccacctcagtctctcaatgtgtgctattaatgaggcctctgagcttcctatccagcagtggtgaaggccttgccctgggtggcaagatacttgctctatggtcacagctcagccactggaagctgtgcgacctcaggtgagcaattcactgtccagtctccacttgtaaaaggaacgctggtgaatcctaatgcattcatattaaatgtctgttgtcaggctcagaagagccatgagctttaagctgtagactgaataggaagagctaccttatccctacctccctctaaagcttataaagcttgctaaacccagtccctgccacatgcccttaatctaacctttatcggctcttttgttactcagggttctaagacagacttaatttcaggttccacatgggaagcacagcaaaaggagcctgagtg

SEQ ID NO: 7275 - DNA, 1166 bp, Homo sapiens
gagccaccgtgtgcgtggtgcgtgtgttgtaggtgggtcgctgtgtgctgtgtaactggcaatggggtctgttaccctgcctgagcccctcctggcgcatctcttcgcggctctcactgcctgcggtctgctgcctcctggtggccttgtgctgcagggctcttctgaggtcaggcccccgtccatggtgggaccagggctgggtccagctcaggtgggtggcagggccagcagtctatgtgcagcccaggggcgcagtacacaggggtgacatacaggtgcatgtcctgcctgatggagggtgggtaccttgagccccaggtgcatgctgtgttggctcacacatcctgtccaggtgcttggtgtgagggtgattacgactgcacaggtgcagctgtttacacgcacatggtctcatgcaccccggtgagttttgtttgtgtgtgcaagcttgggagcctgacaatttctggcccgaggacagtggctggggctgccatgtggatggggaccctgttggggtttgtgcatccaagagacgcccgctgacccagaccttgcttttctcgtccaggactttgaccagctgctggaggccctgcgggccgccctctccaaggacccaggcactggcttcgtgttcagctgcctcagcggccagggccgtaccacaactgcgatggtggtggctgtcctggccttctggcacatccaagtacgtgtggcctctcaagtgagattagagatttgcctggaggagggtagacactcaggtcccaggcacactggctccacaggagggtgtgaggggcagagacagccgggtgtggtcccagagccccttccatcagtcttgggcagcccccaagtcctccccagcaaggggctcctggcgttgggagggggcttctgtctcagcagctgtcttccctcagggcttccccgaggtgggtgaggaggagctcgtgagtgtgcctgatgccaagttcactaagggtgaatttcaggtgagcatgccctgcggggtccctgaggcaccttgggatgggaggaggaggaggactcctgcttgccggtctaggggtcctcaaagcacgtcccaatgcagtcacgtctgccacctcatcatatcagtgcttccctgttcccattttatagatgagccc

SEQ ID NO: 7276 - DNA, 2373 bp, Homo sapiens
aactcagtggccttagtggcaccctccctcccctgaaacactgctcctgcctctgctctcctcccaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttgttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtgagtgcacctggctgctaatatgtctttagtgtcagacagacgttctagaactggtacaacaggctgaggtccctgccccttcagagtaagggtgggcaggcagagtgagttgagagcacctgttcttggcacttccagctctagagcaggcgggtttttgcagacacgcatccccagttttgcctcaccctcttacactggatgtcaggctgagctcctccttgaagaaagcaacggaaccagcgaattctcactaacatatgaaggattgctgcatctagggaaacagtatagagcaaagtggaattgggggcctgtgaaggagcctggatctcagcctccactttctcccctaacccctgtgggccccacctgacccctttgggcctctggttgattgaacacacctcacccctggttgagtgctggcatttaaa

SEQ ID NO: 7277 - DNA, 1919 bp, Homo sapiens
tcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaaggttgtgtgtgtgtttctttttctctctctgatttatgggaaggggacaatgaagccagagctcgaaggttgagggctgggctgtagcaagagaactgggggtgggggcgcagctcactgtggctgtctcctgtccctccacctttccacccatgccctgctgcgtcactgccaggtgggacacagggttgccactggtttcttggctactgaatctcctgtttccctgaggcccaagttccaggacaacactttatttcaggttattgtgaaattctcaacctgtttaaatgcaactagaggccagtggggcagagtggctcatgcctgtaatcccagcacttttggaggtgggagttccagaccagcctgagcaacatagcaagatcccgtctcaacaaaaaataaaaagaacattagccaggcgtggtgttgcacgcctgtgg

SEQ ID NO: 7278 - DNA, 1099 bp, Homo sapiens
gtttatacctcattgtggtttgtttgctggtttcatctctgatgatagtgtgctgaaatttcacacttttcattttgctttcttctgccaactctgctcataatagttctcaaaattcctaggactggataggaaaggagagaagaaggaagctattgcagaaaaaggccactccaaagccatatagagaacaaaaaataagtatagacaaaggcaaatgttcctgctgttagaaggcagttgaggatgaggacaacattattatcagattgcctttattgtagctaaatgctattaatatctttttcacattgctgataataatgatttttcatctttattttattgtgctaactctattgaacttttttcttgatttgctataagaatgctgttgggtttccactcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttctaatcaaatttatttttattttattttattatttttacagacaaagtctcactctgtcacacaggctggagtggagt

SEQ ID NO: 7279 - DNA, 2739 bp, Homo sapiens
gatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacaga

SEQ ID NO: 7280 - DNA, 2609 bp, Homo sapiens
ctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttggctgtcttcctgttggtaattgggaatgactccgttgctcttctcaaaattccatggaaggtggaggtgtcactgtcagttcagagctatctgacccccaggagatgagcaagcccaactgcctcattttatagaagggaaaactggttcagagaggggtaaggacttccctagagtcacacagcaaggaggagcctgtggtccatctggatcccggtccttgtgcatccggatctgttcaggagtttgtcatgtgagtctgccaggggctaggtaatggttgagagggatgacacagagatgaagccccagcatccctgtccgtctctgaggagttcagaagggggtatccccaagggtgctgaggctgtgaggtcagttcagaaacct

SEQ ID NO: 7281 - DNA, 1963 bp, Homo sapiens
ggggaaatgtgggcctgcttctcaaggcccgagctggtgtgtagcctaactcaggcaaggaggttctgcctgggagttagtgtgcaggctgctagcaggacgctgggtgccgggtgcaggtagatgaagggtcctgagccctgcctgcgtgggtactcatctgcaaactgctgcaggcatctgctgctctggactcgtgccttagaagttcccaaaactctgatggccacgtgttccctgtttttaagtgagatcctgtcctgggtcttcagcatctggtgccatccagctgacctaggacaagagaacaggtcctgttttggggtgatatctgatacattgatgggccgggaacggagtttttcatccgaagactaaactcagcttcctctctcctaccaggctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgtttctgtgacccttcagctggaagagtttgttcctctctgatgagctctgagcccatgacacctttggggcccagcactcccatgacccatcttggccagagaatgaaagcaaagtggataaaggaagatcccacctcatcctccccaagactcagggccagcagtaggtcaggcgcacctgaaggtcggctctgctcttcacctgcccctgtccctgctccctagaggccagagtcagagcacgttgccagttccttgagagttgccttgatttttaaacaaaccattccagaaacttgtagtgagtaccagttaaacaaaaccaaggggaaactattgagggaataacttaatttaaaaaaggaaca

SEQ ID NO: 7282 - DNA, 1936 bp, Homo sapiens
catgagacttactatcactaaacagcatgggaaaacccgcccccgtgattcagttacctcccactaggtccctcacatgacacgtggggactatggcagctacagttcaagatgagatttgggtggggacacagccaaactgcatcattgcctaataggagaattgaggaagcttaggggccactgtgtggttaggcactcggattgggtaattttgtcattcttggtatgctgagcagtttgaatttagacaacaggtttgtgtttcttttaagggatttaaagagagggactaattcagaggcactagatggcctgtcttattttcccctggggagaggattttcagcaggacttctttccatcccaccagagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggtaagacaacgggctggccactgaggacccatttttggttgcactggagatgagagaccaaagggacagagagggcacgtgtggttcttaaactggggcttatccctgtgcgtgactctgcagtcacatgagccagcctttaaatggttgtaccatgaagtttctaaagaatgggatatttaaaatatgcaaagattaatcccctttaaaaaaatttacttcttttatttttgagacagggtctcgttctgtcacccaagctggagtgcagtggtgtgatcatggttcactgcagcctcaacctctgaggcttaagtgatcctcccaccttagcctcctaagtagctgggagtacaaatgcacaccaccacacctggctaatttttgtattttttgttttgccatgttgctcagactggtctcaaactcctgggttcaagcgatctgcctgcctcggcttcccaaagtgctgggattacaggtgtgagccactgtgcctggccaacctttttatttatactaaaccccctttttataccatactgttactataatgaacacttaatcgattttaagcctatcagtaatttgagagcctgtaaagcatcttaggaactggtcagcaagtgccccctaatgctgcagccctgagtatataaggacgttttcctaggaatttgagtcctcttaagttgcaaacctaactgcctcttctgtaggataatggggacgtttgccaggactgcattcagatggtgactgacatccagactgctgtacggaccaactccacctttgtccaggccttggtggaacatgtcaaggaggagtgtgaccgcctgggccctggcatggccgacatagtgagccttgtgtccttgtgcattggggatgttctgggcctgggagttgggctgtggaggctggagtagggcgttcagacaacatccttctcttttttcccagaaagcagcttgaataggtagtgcagacttgaatctattttggttaatggcatctggatatgtaacaaaactgggaacaaaaagtaggagactgtttctgggaagattttgtttcctgccaggcaccctgtgtattaggaacactgtagaaatactttttgcccccattttttttttttttttttgagactgagtgttgctctgttgcccaggctggagtgcagtggcgtgatctcagctcactgcaacctctacctcatgggttccagggattctcctgccttagcctcccgagtagctgggattacaggtgtgtgcaatcacgcccagctaatttttgtatttttagtagagatggggtttcaccgtgtttgtcaggctggtctcaaactcctga

SEQ ID NO: 7283 - DNA, 2190 bp, Homo sapiens
aatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccatctgctggcaatactctgattattcttacccttggtattatttttcacgaaaacagcatttatggctgagcgtggtggctcacacctataatcccagcactttgggaggctgaggcaggacaatcccttgagcccaggagtttgagactggcctaggcaacatagtgagaccccgtatctatcaaaacaaaaaaattaggctgagaaggaggggcagtgggtgaggctaaggattgcttgagcctaggaggttgaggctgc

SEQ ID NO: 7284 - DNA, 1114 bp, Homo sapiens
ggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggcc

SEQ ID NO: 7285 - DNA, 1141 bp, Homo sapiens
ggggcgtggcggtgggtcggggttcgactgcgagctttctggggctcaatggaggcggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctggtgagtgtcccttctgtgtgtgggtcctagagctcgcggtctggtctggtctggtccccagactgacgcctggtcggtccccctcttgtcttacagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccgcctgtgcgtttcgttttgaagccgctctaataccccttcctgtgtgctctcctttccagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgct

SEQ ID NO: 7286 - DNA, 2814 bp, Homo sapiens
ggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccagagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggccgtggtgggtctgcattgagcagggaggcctaaggggtgggggggagggggcacaagcccctgctgctgctgacactgtccagcctgtgccacaaggagctctagatgatgagcctgaatttcccccgacccctggccctggctaacagccacttaagccacacatgctgttccagaactaactccatccaggcagaggggtgctcaggtgactggggggctgcaggacctgagcagtctgggtccctggggtccccagcgccagtcctggctgggcatctgggccacgaccatcaccctctgcttttccctctcccaatccctcccccccacaccctcaggcctgccatgtgcccgcagagcattcgaaattcccggccccagcctggagctcgatcccactcaggagccagatcctgggaaaagtgttgcgagtttgtttccatcgtccttcccaccatcctccc

SEQ ID NO: 7287 - DNA, 1162 bp, Homo sapiens
gtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagttccctgtctcctttattttagggtcctctaggcccttttcattttatgtccccactggatttgagatcttgctggaagcagacctgttttctttctaccagagtctggttctttctgatgaagagcagctttaggcacagacaaaaagtgagggcttttggaggttagtggtggcattgtccccgcacagtttggttagcatttcattctgggccaaggtacacagtccttgcttattcatgccccacagtaaagaactaagatggggagtatgtgaggaatcatctagtatggtggacctaagttgtgtggggttttttggttttgcttttgttttgagacagggtctcgctctgcaacccaggctggaatgcagtggcgcaatcctggctcaccacaacctctgcctcccaggctcaagccatcctcccacctcggcctc

SEQ ID NO: 7288 - DNA, 1192 bp, Homo sapiens
taggagataatacttttcacgcattatctcagagaagatcagtctgctgaggacataagtgacaggtccagatttttttttttttttttaatactagagacagggtttcaccatgttggtcaggctggtcttgaactcctggcctcaagtgatctgcctgcctcggcctcccagtgtgctgggattacaggcatgaggcaccacgcccaccctccaaatgtttttttgaatgggcaaaataatccacagtaaatatagaatgtgctttatgtctaaatgctaagaacatataggcattaatgacgttgaaaacattcttttcttagtactgtattgataaatgtgtggctagctttttggtggcagtaataaacatgaatagcaacaaagcaacaacaaaactgagggcacatttggaagacaaagagatatgaaggacaatatgggatctggtgttagttttgttttgggttttgcctgctgcatgggtcacaggaaacatttagttacagaactggagacctattaaaatcctctcatttgtaggcctgtggtgtgtgtttcttatagcagagcaatggctgctgtgtgactgtaagtttggaatttatggtaatagaagctttaaatatcccaaacattacagtaaaggtggaaggagcccttcttaaagaagcaaggtcaaatattcattttgaagttgaaatgaatcaacaggcagtctctgaagaatgccatttccaagttcagagaagatgcagttatgccatcataacatcataacagtctgctggtttctgcatgacatgtggatataaaacaccatcttttctattgagaggccctaatttaaagcaagaaagttcagtggttgtggtgactttttaaaaagttgcttcaaacattatagggtgaagaatttttctttcttggaggataccagttaaccttagacctcttagatttgtattgtttacatatatcgctaatgaaataatttttttctcacagtttaaagtgatctgtgagcatgattatcttccctaaaataagtaacacccaaaataagaatatatgatgtaaaaattttaaatgagttaataccagcagcaaaaatattacttgacattccatcatattaatacattaagttctagttaccaagaaccctttatatttactcgttgttaca

SEQ ID NO: 7289 - DNA, 1267 bp, Homo sapiens
tccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaatgtttgttttctgtgtggtgtttttcgtatttaaatccgaatgtatgatgtggcagtaacaggttaacttatgtaatttctttagtacatagggcttaggtttatactcttggtttccactcacactaatgtcacatggttaagaaaaacttaggctctctgaagtttcagatatttcatgaatcaagatgtgcttccttcaaaga

SEQ ID NO: 7290 - DNA, 1248 bp, Homo sapiens
actgctctatttttatactgcctaataaaagcatctgggatctttgtttaataacttattttttctttttcagagctatccattttttattttgcccttaaaaaaattcctttttttttttttttttttttgccacaagcatttaactgtgaggtatttaggaaaacctagttttttttttcttctagaaactttttgtctctgggtgctttccagttactttgtgccatttagagcaatgccaggcattcatttaatattttcataaacatggcttttttttcatatttaaacatttgaactttattttgatgagtgaagggttaaaagagatacactacctttctccttatttaagacctcgcctctctcacccagaaaataatcattaatactgtatttaaaattctgaacatcctgtttgaggcaaaatatttgcagagtactgcttcttttgtatgtttttccagagatactctgtatatgcaagcatgattattgtctcttatctgcataggaatagatattaaaagtattattactgtaatatattcatcatattcttaactttatgtttagacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaagggtaaataatgttttctttctttctcctcaatttactgtacctttgtatcaatttttctttgtaaaaaaataggataattgatatacgaataatgccacagattttttaaagatattttgcctcagcataatggagttactaatgatgctgtgtttatgccagtttttccatttgttatcaacacaagtaatgtacccttaactgggttttaagcactgaattatgaaaattattgtgagatttttattcaccattaacaaatttgtgtttcactgtcttcctgataaacttttctctgtattttggagtcttttaatctcagaggctactcaaagcccagctttttcacttctgtatttttactgaaagaataccgtggaagtatttttattcccttttaggcacattgttactattataaaaagatataattgggcacaagtattatgttaatttgaaatggtgatagttttctgactttaacccacagaa

SEQ ID NO: 7291 - DNA, 1234 bp, Homo sapiens
attccaaaaaaactccatacccattagtagttattccacttttccagcccctggcaaccactaggtactttctgtctatggataatgttgtgaaagcttgtgttttaacttctcaaacagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatgatgattaagttctgggggctttgtaaatgatcccactaaaatgtgacctaggaaaaatatgaatggtgtttaggatgagagaaaaggggaaaacaatagccctggtcagctttataatagagagcctggtttccctagcatgaagagatgtatgttgtagtcctgccactgattactgaagtcctgccattaattgctgaatgtcttcagttgggccactgagcttgtctgaatctgttcccttttataaaagagttactacatcaaaacaaagagtgaaatccaaatttgtcaaactgtatgtattaaacatgtccagttttttggttaaaaaaaaattgcactggctttgagggaaaacacacagggtgagggaattgggctaaatgacttcttacaggcccctttctgattctttaactttga

SEQ ID NO: 7292 - DNA, 1207 bp, Homo sapiens
ctgaataatgctgctatgaacatggatgtacaaatatctgttcaagtctactttcacttattttgaatatacccagaagtggaatttctaggtcatattgtaattctttggaagtgtttttgttttgctttgaggaattaaccatattagtttccacagcagctgcacccttttacttttccatcaacctgtgtacaagtgttcccatttcatggcatccttgccaatacttactatttttttggttttgataatagccatcctatcaaatgtttttaaatgactaatatctttggaataatagatgaaactagtactaccctgaccaagtattttacagagctgtgaatcagaccttcattgggtagtgctagcattggtatgagtgccagccataaaatgtcagtcacttggtgttttcccccccaagttttgattattattaagatcttattatttaaaaagaattttaagaaatgtcagttgtcacagatgtttttctgacagaaatattatttcttatgcagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtca

SEQ ID NO: 7293 - DNA, 2046 bp, Homo sapiens
aatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgttatagtggtattgggaatttactgggtgttctaacaataagaaaaatattagtgataattgcattttcctatcattcctttcttctttgtcataatcacaataagtataggattttgcacattgagggatattaggatattgctcaaaattatataatcatacaataacttgaattatagttctcaacaata

SEQ ID NO: 7294 - DNA, 1154 bp, Homo sapiens
ctgcgattataggcctgagccactgcgcccctgccctgattccattctcaaaaacagaaccaagtgttaaatttaactttctaccagtgctctaattcctcaactgtgacttcctcttgttaatattaagggagctagtgttcagtgtccagttgagtactgccttactgattgtcctttgttggtttgactcaggaggttaagggatggattttttttagcacttagaaaagaggctcaaaccattgactgtcttatcaaaaatcagatgtctctttgtagtcctgagtctgtacataaatagtgttaatggtttgagtgtttacgttgtatgggtatgtttgtaatttttcattctatccataaggcaattttctagatttttctctcttttatcccttacaaaagatctgaaagcttggtatcagctcataatttttgagactaatttaaaatactcttttttcccactttgaactgattgtcaaaacatataatttaaaatacttttatttcagatgggaatttcatatgggaaacaaacatatacttattaagttagtaaacagtaacatgtagcaggattacttttgattctctattagccacaatcacaaatgttggaatttaacatctgcatttcagtgcttttcattaaaatgaaaaaaaagtaaccataaaattatatctacaagacattttatacttttatgtattttcatgtgaaatgcattgtctgatcttaaacttctgtggtaggcagggtagacatattagtcctgttttataaatgagaaacacattagttgaataatttaccaagcattgcacagctagtatgtgctatagtttagatgagaatccagcccttctaacccagtgttctatacagtaatataaccagtaactgaaatctatgtaggtcatttaagattttaattatatcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtggga

SEQ ID NO: 7295 - DNA, 1137 bp, Homo sapiens
tagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaattccttgtcattcttccctttgtatgctcttgctttctttgtattggggctggaagtctggataaatatatgaagtggcttttgactgagtggaagtgaggagccagagacgagttgaaggatatacaatcaaggtgggaatcaatgggtcctaaaatagggtgcctttcctttctagtattgctgctaggatgtttcccatccctttcctgacagagcattcagtactcagtacattatacacttccttcctcccctccttaggaagattttctggggattcaagctcttcttacagactcactcctgatcaatgtactccaggtgccttccctctatcttataagtttgtgacgtgcct

SEQ ID NO: 7296 - DNA, 1084 bp, Homo sapiens
gaactgctgcacccagctggctgatctatatcgaaactgtgagactgacacgctcatcaactacatggccaagtttggtgagggtagaagcagggcagggtgggattggggctgagaggtccaggatggtgagtgggtagttgtgatggtgggaatgcacacatgatgggcagctgaccagtgactatctttgctttcccatccagcatatcggggagtcctgaatagccctgtgaaggctgttcgtgacacgctcatcacccagtgtgcccagatcctggcctgttacagaaagaactgtgctagcccctcctctgcaggacaggtggggcaagtatattagtgggaggtggggttgttgggacaaatgtttgcatttgggagggatttctcatgatcattgactttattttgataatcccctcagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttggtgcgattgagggttggagtatgagatcttgcacggagcaaagggcctcttaggaggaggaaaggataggctagtatcagtcagacactagtggaatttgtttttatgtattttagctgatgtaattttcacactgagagagttactgagaccccagaaggggtggtgtctgaggacttagctttcaaaattttgtgtgtggtgcgggggggcagacttgtcttatggtccttggtaaccttttgctcccttccttttgtctagacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttggtgagggcagggagtcaagga

SEQ ID NO: 7297 - DNA, 1841 bp, Homo sapiens
ttctggataatccactgtccaagaaggttcgaggcctcattgatagcttacgggcacagagatcccggtacatgaaggtaacactgatctgaaccctggatttcttaccttgtcaagtcctcacctagaagtgggggttgggtggggaatgagtaagtgactgcctaatgagatttctgggcatgtttaatttcctttggccttgccttatgaaccctgaattctggccgtagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaaccattagcctcatctttactcccgaaagctcactttgcttttagtcctggccgtcggctgagcgagctgcgcatgcgccacgtgcccccgtggcgtagggcctcgtccggtcacgactatccgctgggcggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccgg

SEQ ID NO: 7298 - DNA, 1841 bp, Homo sapiens; identical to SEQ ID NO: 7297

SEQ ID NO: 7299 - DNA, 1141 bp, Homo sapiens
tgtgccagtggctcttcagaggacccttcctctagctcttcatttgtttactgtggggtcaggtgacaggttggggtaaagggtgaagaggatacaccgtaccatgtgcccacccttatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggctctctgccaggccagagctgagatctgtaagttgggtccctagggcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgc

SEQ ID NO: 7300 - DNA, 1138 bp, Homo sapiens
ctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctcc

SEQ ID NO: 7301 - DNA, 1184 bp, Homo sapiens
ttgatctttacttgcaaagaatggagcggcctcattggtgtgctgtgtaacacagggacaaaaggcctggagactccctccactgcagtggcaccttggacacattgctgagcctctgttccctcctaagtatagagctgggcttaaaccagagaatgttggagtccccttcccgctctaatctgatgttctggcattctaaacatgactgttctgtctgtctttccaagtctttaagttgacacaggttctggaatagccgcagggcttctccaactctgccagtcacagctttaggtaccacagagtatcccaattacaggagttgagttgaagacagaaccagtgttgcagggtatgaagctcaccaataccacattcttctccctattcctgctccttagttcccatcaccagaatgggacacggtaactcctgaagccaagaacttgatcaaccagatgctgaccataaacccagcaaagcgcatcacggctgaccaggctctcaagcacccgtgggtctgtgtaagtgtctttgctagtggccaaggagctcaggggtgtcagccttctgtgtgccctcggcaccaccccctccttcttaccagcagagattcattctgggccccaagcaataactgagcaggcgggcagaggactgttgagggccagggtcaataaatgtcaccagggagactcgggaggctgatggggctggtgggccactgctcctctctcccccactcatggctgtcaggctgggattggttctgttcttggatgagggctcaggttgacccttgtggactccaggtagccggtgatagaaagcagctggcaaaacccaaagtgaattcccaagctggggttcatactcagatctcaactccactggagtggtgaccaagatccaacaaatcaacagaaggggtttctgagtcattaaaagcataaaagctgaggcataaagcttctgcgctaaagtcctaggagagtcctctaggctatcagtgtgggttgacgtactctgtttttatacacaattctttcaagctgaaatatcaactttcagacaaagaagaggatttggtagagttaggcatcttgacaaccacgaggcattatttatctgtccattctgtgtttattaaatacctctttggtgctggttaccgtctgggt

SEQ ID NO: 7302 - DNA, 1153 bp, Homo sapiens
aatttcagtttttttgattactagtgaagttgcatattttcatgtttggtttctagtgtcagaatcataatagcttcaaatatttttcccagttccaataacttcgtttttttctgtatagatagttttgtctgtctaacttgattcatgtacttcatgtaacattttagagatgtggcctagttttttggcttaaatacacacacttatattctcaatgatgaatttctcctattatgctcagtaatgctttcaaattagttattctgaagaaggagtaatacaacattatgtttgtattccatattgttattctagtatattgtgaaggcatattatgtgagtaatcctaaaaaattttttaaatccagaaatctcccttaaatctagaaactttaatgatagattatgtttaagtatatgtttcaaatatgcttaagtaatagttttttaaagtctgagaatttatatttgaattatgattttttttcctcttgtaggttggaaaagagactgttcaaaccactgaggatcagattttgaagagagatatgccaccagcatttattaagtgagtaattgaaatattcttctgttgctaagcagaataatactcttgttaggaagaaaaagtagctgatttcagtaacaacttttttttggtataaaacttttgtttacaattgaaatttcaacttttttgtcttctaacttttttaaaaaaactgttcattttagtttttgatattaggcatttttgacataataattttttttttttgagacggagtttcaccctcgtcacccagtttggagtgcaatggtgcgatgtcagctcactgcaacctctgcctcttgggttcaaatgatttgcctgtctcagcctctggaatagcttggattataggcgcgtgccaccatccctggctaatctttgtatttttagtagagatggggtttcaccatgttggccaagctggtcttgaacttccgacctcaggtgatccacccaccttggcctcccaaagtgctgggattataggcgtgagccactgtacctggccaatttttgacataataatttttaataagaccatgagttttgagtttttctttccaaaatgaaaagtattcagagacccactgtgactat

SEQ ID NO: 7303 - DNA, 1178 bp, Homo sapiens
aaagcccatctggatttgcagcatttataccaaccgtggttgccagccttcttgtatccaccccagacaaccagaaatgcaacatcgggaggaaacaaggaatatgtctgaaaccatcactgcatcaccaccacgttatctgtgaataatattttctccctgtccctctcactccccagccatctgttgcttgttggcagcttgtagtgctcaagatgagccatgcggaggattccaataaccctaacagcctatttcttattcctgttacctctcttcagacacctcaggagttccactttcatctcgggctgccatggaccccagtcacagcaggttctgcagggacagcaaaaagcctacattcctcattccttctttcctatctctccctttacagagaatgaagacgattcagaggtgccacttcaattgcacagacacaggtttgctggtggttggtttctcctttttaaaaaaactacgtagttgataagttggaggaaactttgagacaagttgtattaaatggtagctattgtggttccttgaaatgtgaacccactgaaaatgacagggacacttactgtatccacaaacaccgcctcccagcctctgaaaccaaactcgggctcggactgggcaaagacactattcaaagagaagataggagtggtgacaataaacatcacgccaggagggcagcattaaaataaaagagactcaaagagtctctcttctgacaaagttgcaaggcttgaatgagaagccgccactgctcagcagccttaagcagagccaagtacactgctcagcacgtgaccggccctttatccaattacagctgagtaacagaaccagtcccgctccaatttctcagaactcattcttcatggattagacaacaagatttgtatagaaaactctacctgtcattttttcaacattatcgatccactggttcttcatggtctcaaaatgttcataagcagcttgatttccagggttcctaagtaagatacgagcagccgagaccacctgacaatgacaaaacacctttaaacaccagagcacccttgctctccagatacaaaccttcagccaagctttctcctctttacctacagatggcactgtaaagccagaaagtggcaagtctcttttcaggctgaatacat

SEQ ID NO: 7304 - DNA, 2108 bp, Homo sapiens
tgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatc

SEQ ID NO: 7305 - DNA, 1481 bp, Homo sapiens
tagaattatacttcacagacattccctgcctgtgtgggaatcttaaccaaaaccataccatcaaagtgcaataatttgtaaatgatagaagagacatttcttccaaatggtggaagggacactggttaatgtcagatttaccatatagcgctcattgctaacattatattggttgggatgatgataatttattctttttcattctttttgatacaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccgagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactga

SEQ ID NO: 7306 - DNA, 1203 bp, Homo sapiens
ttagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccact

SEQ ID NO: 7307 - DNA, 1865 bp, Homo sapiens
tgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattc

SEQ ID NO: 7308 - DNA, 1659 bp, Homo sapiens
cttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttc

SEQ ID NO: 7309 - DNA, 1186 bp, Homo sapiens
aagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacc

SEQ ID NO: 7310 - DNA, 1217 bp, Homo sapiens
gcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacg

SEQ ID NO: 7311 - DNA, 1923 bp, Homo sapiens
aagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagcta

SEQ ID NO: 7312 - DNA, 1965 bp, Homo sapiens
actctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagat

SEQ ID NO: 7313 - DNA, 1157 bp, Homo sapiens
atgttggtcaggctgttctcaaactcccaacctcaggtgatccgcccacctcagcctccctaagtgctaggattacaggcgtgagccaccgcacctggctgaaacttttttttccccatatattttgtttgttttttggttgtttcaggtcagaggataaatctggttcttgttagtaaatcttggtcagaagcacatgtcctttaacagatcatttatttgtattaattattgataaaagctgaattcttaaacatttactaatctaatttccttattttatcaatttgtatttatcattcaaagtctcctgttccctgtaattcctttggtacaacataaatattaaattggccctaaagctttttatcatcttttaatatacctctttcatgcaggctttcacagggttagctaagtagtgatttagtatgggcctcttaactattatatagtagcatacaattaaagggcatgcactgacctgataaagcagaacagtgaaatgtgtcatgcttttagggcattcccacagcaggctcaaagacttccaagagacttccacgtataacttatattttctagcagctaaaacgtcagcatcaaagcctattagcctgattgaggttgtaaagaactggtgagctaagacagtggaaaaaaacatataaaagaagagaagaatcattttgaacagagtatgagaggaaactgtcctaacgaataatgctacaagaatgggagtgacatggaacccattggtggtaagctgttagagaaaggggaatgttaacagactagaaataatgtgactgaagaaatctggccttgtattttttatttatttttttttatttttgagacggagtcttactgtgttgcccaggctggagtgccgtggtgtgatctctactaactgcaacctttgcctgccaggttcaagcggttctctgcctcaacctccctagtagctgagattacaggcgcccgccaccatgcctggctaatttttttgcatttttagtagagacggggtttcaccatcttggccaggttggtcttgaactcatgacctcgtgatccacccgtctcagcctcccaaagtgctgggataggcgtgagccaccatgcccggctggctttgttttatgtgaagg

SEQ ID NO: 7314 - DNA, 1265 bp, Homo sapiens
catcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatac

SEQ ID NO: 7315 - DNA, 1183 bp, Homo sapiens
agaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggattacagtttcttattgaaatgtctttgcattattaatggagctggtcagttttttatataatgaattttagtttttgcaaatgattggccaggtgtggtggctcacgcctgtaatcctagctctttgggaggccaaggcaggctgatcgcttgagcctaggaatttgagaccagcctgggcaacatggtgaaaccccgtctctacaaaaaatacaaaaattagccaagtgtggtggtgcgtgtctgtagtcccagctacttgggagactgaggcaggaggatcgcttgagcctgggaagtcgaggctgcagtgagccgagatgatgccactgcact

SEQ ID NO: 7316 - DNA, 1171 bp, Homo sapiens
ccctggaaatgaaggcaggtgttcctggcctctggtgtgtcttcataatgttaggggtggtagagaatggagctagaaagaatctactctttactatgtcttactcttcagggttcattccagcccttgaagtcggtaactaagtcctaaaatgttgggattgtgcaaggaaggcaggggcctggattggtacatgatacctcactgggacctcctcccaaacgcagtggttacatacagccagaactcagcagcaccggcatttatgagaggtgtaagaatgtgaggataaaggattgtttgatctgattcttcagaggaattacttgtcgtttggagattttttttttttttttaaacattcatggttttgattctttaggaagagtcctggaagtagtaatgtgtgtaactaagtcatgaatttaaactttataccctgtgctttaaggctgctgtgtgtcacctctagtgagcctgacttgtaccacattttggtctggtttgttgtgctagactagaattaacaaagatgatttttatgagagtgcttaggcttttgtgctgtatggacagtttggggtctttggatacattccagtggctatcaagagtattgtgtcctactgagaatttgatttttgagttgaatggatacgaattaaatagtacctggtttgtttggcttaatacataatattgaattttattgtctcacgtgaataaaactgaacacttcatgattacatgatggggaaacatgtaggggctttgtctctattgaaatatttttcttacagttgtttttgtattttattttaggcaaaagtcaacaactctagcttaattggagtaggctatactcagactctgaggcctggtaagtattcttgataaagtaggattgttttgatagtattaaaaaatttagttttcattcttcagcttacttttcagacctttcaagcacacagaagagttgaaagaagagtacaataaatacgtgtttaccttttaccacaattttttatttctttttctttgctttttttttttttgctgggccatttggtcatgacacttctcttcagaataaggcccgtctcttcttttctgcataactataatactatcacacctaagaaagttagtgattccttattatttaata

SEQ ID NO: 7317 - DNA, 1317 bp, Homo sapiens
ctcaacattatagtatattctagaacactttgaagttgttattaaaacatttctctgtgacttggtgccttagctagaatggtaacccagttcttctggtgtctcagatacttccaagcgccctctggtggccagcactagtaggtcagctgacaggctgaggaagtgacaggcaggctctggggatgactgtgaaagaaggcccagactgagtgacgtgccaggtacatcacggttttttgtttttgtgtttttttgtcttaataggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataattaatggctccaagtatttgcggagttccacgtttgccagctaggatcaaatccccgtggtagctagccaatacttgatttttccagtgagtattttgctctgtacctaaatctgtgccacagaatcttctgtgtccctagattccacgagctttttaagactacaataagaggatacatgcttttacacttttacatgcacagtttgtaagtctgtgcagaattgccctgcatcattgaaaggaaaaagagaaggtgctgaaaagttacacaaacacaccatacccctgtgagctactgctaggaacataaagtaggccctggtttggtgagatggtgttaagcatacagaagaggagtaaggtgtagacagtgagggtaacctgagggactgtgagaggtcattactcatttccttctaggcagacacactgaaaggtgggtataggtaggagaccagagacaacccctttaggctgcgtggcattggccttcatct

SEQ ID NO: 7318 - DNA, 1147 bp, Homo sapiens
ccttagcctcctgagtagctgggattacaggcgtgcgccaccacacctggctaattttgtatttttagtagagacggggtttctccatgttggtcaggccggtctcaaactcccgacctcaggtgatctgcctgcctcggcctcccaaagtgctgggattacaggcatgagccaccactcccggcctaacacgatggattttaagtcactgactgggcagatgggggtgtaggggttggggtggtggctgctggttttagggctggtttctttcacagagctcaggtgtgatgccaaaccttcacagttgcacttaggccatcgtgattttattttcttctttagatttttctgtaatttccagattttctacaggtaccttggttttcttttataattacaagggggggaaaatcctatgtctttttcaggtggaaggcacttaagtcactgagatcgctctttctggacacacgggccttgcagggcagccccgagacatgctgtcaagcagccctgaaaggatttgtaccctggtgggttagaggcttatttaccccacatggagactgtgctggggggcggggttgtgggcacagccaaatgggcctcctcctggaggtggtgtctgtctcacactggctcagatcattctggaaaggcagagcagattcttcaactccagccatgagaccaagaaattgaatatgagatgacctctgcggccccttcccatgctaacagctatgattctgtgatatgggtgggcaacaggactcaaatggagcttgactttgctcctggcctagcagagactgtgggaaaccccagcttcaaggcaggaggagacctcatgcttaggcgccgaccctgagcagctctggagtagaagccgagcaccggccagaagcctcaggcctttctttccagccaagacaaagctttgaggctcaacagcagtgggctaaccagaggcttggggaagccgagctgccacctcctgtggggttgatgagacacagggccacaagggtcatgatgtcaaagatgaagagaaacgtgaagtacaggaagggatgcagagtgaacataaaccgcagacaagggtgcacgtgctggcgtgggaacggtggacctctcagcagat

SEQ ID NO: 7319 - DNA, 1510 bp, Homo sapiens
actttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaggctgtgtttgaagatgtgagtttttaatctcttcctagtcagtcagctttcctgtatttctaaacttgagacagcttctcctctgcagcacgtagctggagttggctgatgtgtaggttctttctgtctcacatgacaatttgcagtccctgctacccgctgcatcagcctctctctcactccttcctgcccttccctgccacccatctgtccagtgtggcatgaactggtgactgcagccaggctgcccatctgtgtgagacccagattctgccctctggccctcacattcaattctgcaggcttgggaaaagcaaaagggagtgagctgagtgctctgggtagcattctcagtcagggccctgtctggggcccttggctgggaatggccccacctgcttgggggctgctttgtagtacctgacagcatcacactgggagatcacccagcattgctggactcccagaacagcccacgtgggcctgaactccgtgtt

SEQ ID NO: 7320 - DNA, 1073 bp, Homo sapiens
ccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaact

SEQ ID NO: 7321 - DNA, 1100 bp, Homo sapiens
ccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggaca

SEQ ID NO: 7322 - DNA, 1190 bp, Homo sapiens
acctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcag

SEQ ID NO: 7323 - DNA, 1110 bp, Homo sapiens
aaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttga

SEQ ID NO: 7324 - DNA, 1096 bp, Homo sapiens
gtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaagaggctcacaggtttccttgttcacgcaagcatgtagggaggctggactctttcagaggcaggagacggggcaggcatcagagagacttggggctggcctcagctcccctgggtctgggtcatcttgtcattgccctgcctccatgccattgatttgcctcctcccagcctctctgcccccaactgtacactctccagggcaacggccctccccaggttggccccagactgggtgagattgtcggcagatgaggtcacgcgttcactcagcggggggactcccgggtgaccatatataggagtg

SEQ ID NO: 7325 - DNA, 1225 bp, Homo sapiens
tccttcccctctgcctcccacccactctgggggtccacatcaagatagctgggcccagtgtggaagcccagcgtgtctgttccagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgc

SEQ ID NO: 7326 - DNA, 1449 bp, Homo sapiens
aaaaaggtgggtttgctgtgttgcctcacactacttgattcatggttctgattctaaaaatctcacttgatacttgatttcatatgaaagacgtgtaaaatgcctgggtagaggcggcggcggcggcggcggcggcgggctcggaggcagcggttgggctcgcggcgagcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggccttggtgaagctgccctcctcttctcccctcacactacagccctggtgggggagaagggggtgggtgctgcttgtggtttagtcttttttttttttttaaattcaatctggaatcagaaagcggtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaagaggagaggggaggggacctgccccctcctcaggcatctgggaagggcctgcccccatgggctttacccttccctgcgggctctctccccgacacatttgttaaaatcaaacctgaataaaactacaagtttaatatgaaaaaaaaaaaaaaagaaagaaagacgtgtaaaatgccaagaactctaggaaacagggacaaaaacacttcaaagagaaagttcatgcacttgtttctgaccacccagggcacccttcagcaca

SEQ ID NO: 7327 - DNA, 1144 bp, Homo sapiens
cttcgtctccctgagggagaccttggcaaggagactgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggctggactcctcctacacaatttatttgacgttttattttggttttccccaccccctcaatctgtcagggagcccctgcccttcacctagctcccttggccaggagcgagcaaagccgtggccttggtgaagctgccctcctcttctcccctcacactacagccctggtgggggagaagggggtgggtgctgcttgtggtttagtttttttttttttttttttttaattcaatctggaatcagaaagcagtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaggaggagaggggaggggacctgccccctcctcaggcatctgggaaggccctgcccccatgggctttacccttccctgagggctctctccccgacacatttgttaaaatcaaacctgaataaaactacaagtttaatatgaaaaaaaaagaaagaaagaaagacgtgtaaaatgccaagaactctaggaaacagggacaaaaacacttcaaagagaaagttcatgcacttgtttctgaccacccagggcacccttcagcacacggtgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagcctggagggaagctaaggaagcattctgctctggagtagacatgagtgcatgtgaagcttctgatctcccatgagag

SEQ ID NO: 7328 - DNA, 1213 bp, Homo sapiens
gactacccccgcccccaggctccaaagccgggcaggaacgcctcttatctccaccacagccattttcctaatccttcgcccgctctccacggtcatcccgtgtatccctcgagacgccgcctcccacagctcgtgcttctcccaggttcggctccgacaaggccagagcggcgtctgcgcagcgcaacggctcagagcgctcccggcggctacaagtgcccggccccgggccaggcccggcctgcgccgcgcacccactgggagggcgcggaccggggccgccccaagcctccggcaccgcccagagcgggacaaaggggcgggccggcgacccggcctcgcggtccccggtgccgcgcgggccgggaggcggggtgcggtgggggaggggcgaggcggctgggggaggggcggggccagggcgggcccaggcgcccggggccgcaccgggcggcgcagggaagcggcgccccttcctcggcagacggcaggcgccgcgcctccggccccgcccctccgcgcccctccgcgccccgcccccgccgctcggacggcccgagtcgcgccctcccgccccgcgccgcggaacttgctctaacttcctcggccgagccgggccgcgccgccgctgccgccgccgcgcgcgggtgagtagagcgcggagacctggctggggcgtcgggccctgcccctttctttgtctgaggccgacttccccgagcgttctccgggggcgagggctgctccttaggtccctgtttggcccctcagcctccctccccgcctgcccaggagcggccccgcgggcggcgctggctttgtctgccaggattgctcgctagaggttggaggcctccgccgggaccccgctgagccgaactccggcgccgcgcggacgagagccgcggcgggcccggggccggcactcctggttcggtagccctcgccccatcagcgcgccccggcgagtgcgcgcccgtgccgggcggggtgagggcgacgggagcctggacggccgctgctgctcggggctctgcttctcgtccccagcagcgagctcggggatgggccaccctttcggctcagtcacccaccctcggctcccaggagatcgggtccggggtgggggtgggcgtaggccggggcgggccgccccttcctcctgccccgccgtggttgtgctcagtctcccacgccgccgtgggtcccactc

SEQ ID NO: 7329 - DNA, 1135 bp, Homo sapiens
tgtgtgtgtctctccaaaattcacatgttggaacttaaactccaatgtgatggtatttaagaggtggggtcttggggaggggattgggtcatgagggcagagtccttatgagtgggatgagtgtccttatgtaagaggcccagagagcttatttgtcactccactgtgtgaagacacagtgagagggtgccatccatgaaccagaaagtgggccctcatccgacactgaatttgccagtgtcctgatcttgaacttcccggcctccaggactgtgagaaataaatttctgttgtttataagccacctaatctatagtattttattctagttgcctgaatggactaagataagaacctatatcaacatcagcttccctaattatgattttttttgccacttatattaatttgctaaggctgctgtcacaacataccacagacagaaatttaagccacagcaggcatttattttctcacagtttggaggctagaagtccaagatcaaggtgctggcgaggtgaggtgggtgccttcagagggctgtgatggaagggtctgttccaggcctctctcctggctgcaggtggctgtcctctccctgtgtcctcacgtgggctcccctctgtgcatgtctgtgtcctgatctcctcctcttagcaggatgctcttcatattggattagggggcaccctgatggcctcattttagcataattacctctgtaaagagcctgtctacaaatacagtcaccttctgaagtcctgggggttaggacttcagtgtatggattttgaggacacaatttagctcctaacacctctaaaattaggggctaatactccatcatgttgccatggaggaggctgataggtgtgagggggctggggccgattgccctgtgtggggtgggcagggctggggtgtgtgctgggatggttactgacaccccaccggggttagcagtggagggagctggttggctggcgactgttgcctgctggctctgtctcctggagctgagcttactggtgggatgcccgctccgagaagcacccttcttctcttcttaggagactctggacccccttctccaggtttctctccctttagaggcacattttcctccaagccttca

SEQ ID NO: 7330 - DNA, 1087 bp, Homo sapiens
agtgaaagtatgtcttctgttacgcagaggtaactactattaggaatccttcctgaaaatgtccatgcatctactcaggtcatcacacccatggaatcattttacatactattttatgagtgttacttaatatactgatccacagtgcgttttcacggtcacgccatcagttgtaggagtgtgccaagaacagatgggccttgcctttgtaccagaggagtccatttacagttgcaggtaatagaaaacccaattcagactggcctaaacaatgaggggaggttttggctcttgaaactggaaagtcccaaggtggggtgagtttcaggtttgggttgatccaagtggctcagtgacgtcaacaggatcttgtttccatttctctgccttccacagcctccccttcatctatggtggagggaaggagtctaccacagacaaaccccgagcctccccctgatgggtggtgtggtggtgaagccagcaagggaagggatccccggacacacccctcctcatgctttatcccactgaaaccatgcggctgtgaaatgcagcatcctccaggagggggatgaaggccggggatgctgtcagctattgccattgcacttctgtggatgggtgttacagttttttgcagggttttgcacttacaaggacatatatatatatatataaactacagtgttattggaattgcttcttacagtttgtaagaaaaaaacatgtttttagaggagttctcctgggaggtgggatcacatttttttttttttttttttttgagacggagtctcgctctgtggcccaggcgggagtgcagtggcgcaatctcggctcactgcaagctccgcctcccgggttcacgccattctcctgcctcagcctcccgagtagctgggactacaggcgcccgccactacgcccggctaattttttttgtatttttagtagagacggggtttcaccgtgttagccaggatgggggatcacattttaataagtaggtactcagggctggggtgtacctgttgctgcctgaccactgctggtgtgtgtgggtataaggtgacaaaacctccta

SEQ ID NO: 7331 - DNA, 1360 bp, Homo sapiens
tgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagttctttgatacagaagagttatatttagaagtctttaatgaagggaaagaagtctgtatgatgactgaggtgattgctctttttgacaaatgtttattacagtaatgcagaaatactgttaatcatctcaaagtacataggaggcttatttctgaaacaaaggtttcagccagatgttgattagtctaatttttccaagtgaatcatatgcatgccatttgaatagggatttcttcaagaaagcaacttagtttcttgccagtatagtatagtgcagtgtgataagtacatgatacttgtagctagactacctctatttgaatctcaactcttatttcttatgtgaccttgggcaaattacttaacctctgtgtgcccagtttcctctcctgtaaaatgaatatattggaacctgtcttataggtttatggttaaacgtgcaggcacttagtaagcattacataagtcttagctattgatgcttttttttattagtaaaaatgtaaatgccaattttctatttttcttctccccatcctgatacc

SEQ ID NO: 7332 - DNA, 2385 bp, Homo sapiens
atgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggacca

SEQ ID NO: 7333 - DNA, 1228 bp, Homo sapiens
aaaagaacaaattgagtcaagccaaggaggtgacagagtgcttaatggtaacaggagatgggtttggcacaagaaaggaaatggaataaccacattgttaaagacttattttattatttatgtaagtggtccaatccctggaaataatagaacagcctctcacctcttataccaattatgaataaattttgggcaattctttactatttttgattcttcagtattttaccagggaagatgttaaaaacatggacttaaaagttttttaatatgaaaataaaaatctattggggaggaaagactaggaggaagactaggagaaggatgttagaaatagcttaattaaactagttgaatctatttttatttttaaaaaacttgaaaacctattttattctttcagtgcagataatgagtgaattcaggatatcatatagttcgattttaaaaaataatggttgacatatccttagagctagattatggtatattttttactgcttttgttcacaggatattttgaataatcttgaatcatgtgaccttgaggatgatgatcttatgcttgatgtggatctgcctgaggatgcacctcttgaaaatggtaagttgagacaatattgaaccttcagaggtatatacttgagctactcgactgtagccaatttgatatttgttacttgcagacttcttaatcttaatggagcctttcagactgagaatcagtcttaagtgaggtaaaataggttcatttgcaaactaacttaaatatttaaaacctgattttgtaagtcttagatataattctctatcatccaataacattgtataccataaagtaagttgcagataagagttgtctttttttctgtgtatgtacccagtttttcctccctttatctcattttgattttaggaagaaatgtatttacagaaacataccatcttacttgtgaaacactataatatcttaatttgataaatattttatagagattaattctgggaatgtgatgaccttctgaatggatcattctgtacattttactcccaattctagtctatctttctctctagagccaagtaactgctggggtgaggctttaggtaatccatatgggagaggggccttaggttcttttcactccagtgacatagcacttgtaggattttttttatcttaaagactgttggagaaccagaaaccagcataaaaaagccctggagg

SEQ ID NO: 7334 - DNA, 1510 bp, Homo sapiens
accctctgtccttgctacccttgaggtacaaggcacacacctttcctaagggccccccactgtggcaaacgtttaagagccatggctggagcagaacgtgagatgctgtggaatgaaggggagcctgttcctgtcccctaagaaggcattacataagcagcatcgggagtcctcttcctccggggcctgtctgcagtttcactgcttgtccacatgggctccagctcccatggctgacgcttgcttgggggagcctaggcctgtggcctgggggtgcagttgagcctccttacatggcataatgtgaatctagccctgggcactaagctgaggctgagagggtggcagggaactgcgggcctcatcacaggctcacagggaatgactgagggcctcagaattccccacctgggccctatagggaattgatggccagctctggtctctggccccaggaggtcagcctcaggtggcagagtggcagccgactctggtgctgtcctctatcctggctccacctctgttgcacacaggggcttagtgggctgaccagtgaggggtgtggtcatagctgccagccccttctgcttgcccatgctgactttgtcctcttgctttcctgctgtattagcccatttcatactgctatgaagaaatacctgagactgggtaatttataaagaaaaagaggttaaatggattcacagttccacatggctagggaggcctcacaatcatggcagaaggtgaaggagcagcaaaggcatgtcttacatggcagcaggcaacagaacgtctgcaggggaattgttcttttataaaactgtcagttctcatgagacttattcactatcacaagaacaacttgggaaaaacctgccctcatgattcaattacctcccactgggtgcctcccatgacatgtggggaatatgggcactacaattcaagatgagatgtgggtggagacacagccaaaccatatcacctgcccttccataggcctcgcagtctggttttgaacagaaaaagaggtttaatagattcacggttccacatggctggggaggcctggctcccgtcccctgggcctcttggcactgctcccaggtagggcctttccaggactgggcacatttatgttgtggggatcaggcctgcattcctccttagaggaagaatgattattctctgtttaacataaagcaaatggtgtggcagcgccgggcagggctctggaacaccagccccagttttccctgtcaatgagtgggcatggggtaatgccttgtccacactaagccatctctgtgaaatgggcctgtgaccctttcttcagctgcccaggcccaacatcttgatgctgtctttgctgcttcttcctcatgcccctcataattagtccattagcagttctgacaccatgtgtctggattctgattacttctcaccaccccaatggctatgtccctggtctaagccattgctggcatcagcctcctgacctgcc

SEQ ID NO: 7335 - DNA, 2831 bp, Homo sapiens
aattttaataatcgtgttctatttcttcaaggtaatcattgcatgttatggcaaataactttatcaaacccacaatttaatctcggtgtactttgatttgtagtgttcagtttagtaaatctagaggtaaacttttatttatacttcttaaaatctgttaaatattaactgttacttcctttccccttcaccctgctttcagtgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatacacatgttgtctttaacataagtctattggaggacagaagtgtcacaaactttatatatagccgactctaatgggaaatacactatcacttaacacatttaaccagtttttgttaaatattttattatttctccatgtttttaataatactcatctgaatataatgtgaactcaacaactcaggccaattagggactggattttcagttaggcccttggcatacttaactgttttgatttaggttattttttgctcctatgagtatgatccaagacat

SEQ ID NO: 7336 - DNA, 1224 bp, Homo sapiens
taagggacttggttgcctgaggaaaggtcagtagaaggcatgagagctatacactgaaaagataggagaggaaatgtctgatatgtaaatgttaatttcttcacaacttaaaattatttgcagttcttccaagattgatcatatactattgattaaccacatatatgttatttattaacttttatgttgataccactcatgtttttatcctttgacttatttttacagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattccc

SEQ ID NO: 7337 - DNA, 1320 bp, Homo sapiens
agaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtatactttagtgatgtgttttgtgatgctacactcagacggtattgtgcatcagaagtcatctgttgagatttttgtaatgattaagttagtgtatatacatatgttcctgagatgtacacttcaactaccagaaacccagtatggagcacaggtaggtacacgcttgccctgtggagatagagaacttctaaacctatcacggtgcaggggtttttcctttaaaaaacaagacaaaacattgttttctttttcctttttttttttttttttttgagacggagttttgctcttgttgcccaggctggagtgcaatggcacgatctcagctcactgcaacctttgcctcctgggttcaagcaattctcctgcctcagcctcccgaatagctggaactacaggtgt

SEQ ID NO: 7338 - DNA, 1198 bp, Homo sapiens
ctgcagataccttcccagtgttagcattattattaccttgaggatggatattttctccctctcccctgagtatctcaagattcctagcaagtggtggtcgtctgggagtcagagacccgtgttcctgtcccagcctgccatttacaaaccatgtagccttgggcagccggtgaaggattcaacctgttttgtcaatcagggatactgtctctcaaggaagttggaaggaaaagggatcaaacgagaaagtgctttgtggctgggcatggtggctcacctgcaagcccaacattttgggaagctgaggctggaggatcacttgagcccaggagctccagatcagcctgggcaacatagtaagactccatctctacgttaaaaaaaaaaaagggctgcagtgagtcatgaccactgctgcactccagcctgggagacagagtgagtccctgtctaaaaaaaaaatgaaagtattttgttaaaatgtacaccagctcagacaacagacttgcattttccttcctctctattagtgaaaaacagaattggccatctagcttttctcctgcaataacactgctgttgggaatatctaggttatctagaaatagtgacctatttccattgctaataaggtgaggacggtaggtctcagggtttaatttcccacccaatggtgtaagggatgaatcactaagcactgtcctgttatgtttcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgt

SEQ ID NO: 7339 - DNA, 1146 bp, Homo sapiens
acaccatcacaaggaggctcggctgccagggccaggcattctgccctgcctttgccacttacatctgtttccagagccccagggctaggctgggcccaggatgcaggccccaataagaccctttgcaaggagaagcttgaatagaaccactacgtcctcagacttccctgaggtggagaagcgaaggggttaactgcttcttaggttgccagggaccccgaggggcccagcccagggagccagcagcctgagcattaggactccgggaggaagaggctgtttctgtgccctggcttggggatgtctagaatgtgggtgcctcagacccaggatttgctgtcccagtggaactcagtctgcggtagggaccgtgctgagccccaggcaaggtgtcccatctatcacattgctatgatagcttggaggggtggggacgcctcccagggccacagagctcctaagtgacagtgagagcccaggcccacccaggctgtcctgtccccccaagagggtggccgtgtaggggatgctgctgccagcaggctggttggccccagtcaccagcctcaggcttctcctgacccttacacaaagagcactgagattttcccagctgggagcttgtggcccagaggagtccagcatatgactggaggtcacacaggagcagggcagagcacaggccgccttctctgggccacgatgcaccttttgcacttgttcctcccccatcctcacccccacccccgacccctgccgggcacagagcccttggtatgaacagggaagaacccccactggccagagctgaagcttccagaaccacgctcaggggttcttagctctgggctgatccctgagagcctcaggcttctctgccaaggcccttttctgactcaaggacaaaatcctgtgagtttctcccctggaatggtcaagttaatggctggcttcagggcctcagaaaacaaggctgctgagaacacgccttccttcccaaggaagacttgagggcccctgggagggcgtttcctggctggggaagggaaggcactccacacaatctgcataatggatgcgccctccccctcccacaggctccctctcccttccccccacaccagctctgatctgtgtgccgcagag

SEQ ID NO: 7340 - DNA, 1098 bp, Homo sapiens
cctccccttcctcctctggagagtgccaggagaggatgcgggggagggaacactgagcctaggtttcatcccccagcctgccccttctctctggggagggaggggatccgtgacctggctgtagccgctcccgtgtggagagggtgggggccacctgagcacaggctgctcatggcttcaggggctccaggctcaggggaggctggtatgcttgggaatgtgtgtgtgcgtgcacagacaggtagccagccctgtctgcggtctctgacacccagaggccccgaggaggccaaagacaaacacacataggtgtgcacagggcattgtgggtgctccagggtctggagaccccaccttgatagccagggcctcgccccctcccaaaatgcctccctggggctggggagtaaggtctggcgaaggtaactgggcactcaccctttggccaccacactgtcccaccctgccatgccccacttacccacatacatgaccccctccttggtcttctcagctgcttccgtcaccccctgcttggtcttttccaccgcacccaccacgccctccttggcgatggagaagcccttcttgaagacatccatggtgggtgtgcagggttgtgctgctgcaggcaggacggagctggatctccctgcgagctgcgggcttgagctggctcgagtgctgccgcagcggctgtccccgatgcctcctattgacgccgatgaaatattgatgcggaggccagctggagcccagccagccctgcgtgcagtgggggcggggagggagggagggagggaaggaggttcagcctcaccttcctccaggataggaaggcagagaccaggctccctgggctcctgctggctcagcccagctctcctgccccgtgccctccatgggctggagggggctggccacctcccaacctgtccctcattcatttactgccctgcccacccatgggggcagccctggctgggtgctcttggccccaggggtgctgtgtctatgctgcacctggacagacaggcacagagaggggaggcgccttggccattgtccccagcttcctaggtaggggtcagggccaca

SEQ ID NO: 7341 - DNA, 2219 bp, Homo sapiens
gacctcaagtgatccacctgcctcagcctcccaaagtgctgggattacaggtgtgagcaaccgcacccctgcctaatttttgtatttttagtagagacagggttttaccatgttggcaagtccggtcttgaactcctgagctcaagtgatctgcctacgtcggcctcccaaagtgctgggattacaggcgtgagccaccgcacccagccaccccattgttaagtccagagaattaggccctcctgcctagaggttctgctgctagagtagtttgtctttggctgcccaagtcctgccttgaaacaatgagagggtaacttggaccaggcctgtctgggccttgtgtgtttatggcctggccacttgagtcaggatcatcttcactgcattttctctttcatttcagcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacgtttcttttctgtgtttttacatgtggtagtttctcttttcataagttataatactgcaattggatttctgaaatgtttatagcgaccacctgtataacatttccttccactttattgtgagctgcccagattttattcttgaattgttttttttttttttgttcggtgctttacacgttcagagaaacttcccgagtaacgaactatagaaatgatccctgaaagcatagtctttattctcgaattattttgtattttattaaataatatgaacagctgttcttgagaaagaggctctaatgttgaaagctgatagtgaagtaacttttagtgccgtttttcactaaaggggatttaatgtggaataatttagccacagaatgtaacaactattgaagagagaatactaactgtaatcagaa

SEQ ID NO: 7342 - DNA, 1168 bp, Homo sapiens
tgatcatcaaggactgaggacctggtggtgtacttaacaccactgccatttattgattgattgagatggagtctcaccctattgcccaggctggagtgcagtctcggctcactgcaacctccacctcccaggttcaagtgattctcctacctcattctcccaagtagctgggattacaggcacggaccccatgcctaatttttgtatttttagtagagacggggtttcaccatgttggccatggctgatctcgaactcctgacctcaagtgatccacctgcctcagcctcccaaagtgctggaattacaagcgtgagccaccatgcccgctcatcacattcttaaacagagaattttattgttgaagagaaaccagttagtacattgtttcttttggcaaaagaattttgagaattgcttctaaataaacagagtatggatttacattggtcaaaatatgactcttgctgtctataccaggactttaatttttgtgttatgggtaattgttcttcacagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaaacctagataaatagaaaagtgaaagg

SEQ ID NO: 7343 - DNA, 1153 bp, Homo sapiens
tgtactggtcctggctagccctgaatttgagcttcaggaaaaatatagtacgtgaagaaaggggtcagataatgtttggtagtcactgggttatcctgtggtttaaatcatttaatgtctgtagatttggcctctgtagtcagattgctttcttcgagcaaataagagcttttttccccccaatacattgcatcatacctctttagtaacataaaatggaaaggacaaaccacttttgtctactgtaaaaaagaaaaattatatggaataaagagcccagggaggcgaggagtcttgttggaggtggattggctgagaagcacagaggatgttgggctagacccatgtctcagtaaacctggttctgtggtctttcagttatgcccgctgacttatgaggatttttagaaatcctctctgtaccggaaaaaacttgagcggtgctggtgttcccagcaggggggacaaaggttgtttttaaagatttactaaatttgcattgaccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaagaaaggcaaataaggatgttggaggaagttcaggcaatgtttagcaaatattgagttgcatcgttttcttaaaacggacatcaagtttattttttactatcttgctggcagcatttgccagtcctttaaaaggtgtacagataaatcagtgtatgtggttttctgcaggatgatttggtctctgaaatcctttttcttcgattcttcagatgcccagctctctcctgtttttataagtcgcagctccgcaaactcactgaagcaactcgtttaccatagtttgtgagtcctctttctcttgttgccacagcagttttaatgccaaaatattgaacctagcaacaaattgggtcagccataccaaagcactgttactgtagcacttgcttgtactagagtgtaagatacaattttctgttccgtttatcccattta

SEQ ID NO: 7344 - DNA, 1435 bp, Homo sapiens
cacacggaatttcagccgtatgcttgtgtaatgtatataaagatttaaaaaaatagatgggattatttaaactaaaaaaagatgtggaagttactcctaagtgtaaatactatgttctatgacattaatatatataccttattttctcttaatttctatttgaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaa

SEQ ID NO: 7345 - DNA, 2213 bp, Homo sapiens
atacccttttctacagttgaaaacaaaattttttttttaccacatgcatctcttttaaatcttggtaaaatattttagggaggcatattctaaagttatttgagtatttgatggttttgtttgcattttagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaact

SEQ ID NO: 7346 - DNA, 2818 bp, Homo sapiens
aaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttaca

SEQ ID NO: 7347 - DNA, 1117 bp, Homo sapiens
cttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaa

SEQ ID NO: 7348 - DNA, 1209 bp, Homo sapiens
ggttatagttttaaatcatggcatgctatttctcaatctatttccttgtctgtgagataaattagtataatgtgtaccaagcagctggcatatagtagctgcttaatgaaaagtagctatagttattatttttatttttatcactaattgtaggagtagtttttgattcagagcaggcactgatagggaagtccaaggatgccaggtagggatgaattcccactaaattagaaagaaagtaaaggaagagagctggaggacagtagaagacagtcttggccattttgttcacttgaatggattcagtttgtgactactcacatcccctttattcatatatgcaattctgataatggggacatgattttgcttttggaacaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccacctgtgagtctgcttttgccatttacctgcctcagggaatgggatttcttttgacaaagcatgaatttggtttaactctcttcgcaaaggacaagtgatagactctattgatttgcctgtcttaaaaactgatacttacggccgtcgtcatgatattaatctaggccaaggtgaaacccatagaatgtttttaaagctggttaaaagttgaacacttttcttattgcccatgtcttcaacacgtcagtatttttgatggatatgaaatgattttgcctaaaggaagagcagtttttgtggccatttttgagaaaagatttttatgtacaagtacttgcttggattgcctcctttcctatgttcttgttctctgggttgctctctaattgtgtttacttctgtctgaggcaattgtctagctagctcttttgtgaacgagaggcatgacaagggatgggtgagaggggatgagtaaattttgctgaagaagctgaaattatgccagaagagccaaattttaataaaggaactaaaagtcaaagaaaatttttatcctttctaagcctttggatactgcagttggtttagcattattcactttaccttagatagtaacctttgtttaatttctttttgatataaaacatgtggtggggaaagtatgtgcagagg

SEQ ID NO: 7349 - DNA, 1282 bp, Homo sapiens
aagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaattgtgtgtatgttttttctcttttatttaacagtcatccggttcttccctttctctcttggcagtacttggaactcttctcaaggttaatgtgtttactccgggaaatgaagggctaccaagtaacgagtgatttttaaaaatcatttttttgtatgc

SEQ ID NO: 7350 - DNA, 1271 bp, Homo sapiens
atcattgaaatgcgccctaggttagagaccgacataccatctcttggtacacccagcatggtcagtttttcctctaggattgaagcagatccgtttctttggtaaagattctgacaaaaatagttagcaattgggatccaggatgtatgcaaaaatatatatatctatctttaaatattagtataacactcagcttggtgagatacttgagccctaggaagcacacaggaattgagactgccttagggaactgcagaatcctatttctcatctcactcaattctgagtggagtgcagtggtgtgtgagcagagccttgggcactcttttgattgtaaaattttctctgtctgtgccaccttttaggcacatatagttgaattcaaataaattgaatgttaaatgcacatgtagatatgataccactgcttttgcttatttaatattcaaaaactgaacacttctttgcacgcatagcattcagcagcactctttctttctgtcctttagcattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatggtaggtcgggtttgtctttgttaaaacatcaaaacctctcacatgtccataatcatggccactcataccgaagaaccatactactagccttgggactctggacaagcttatgtcaccgctctgtgcctcagttttctcacctatacaagaataaaaacagcttctacctcatagggttgttacatgtaggattaaatgagataatatgtacctggcacttagtaagtgctcaatatagttatcatcatcatttcaattacaattattgctgggtaatacgctaaagacaagatgctaaaatcccttctgaagtatttcagttagaattgaccacagacttttactatataatcgtgatgccaactttatgcatatataaacagagacccatgggaaggcttctatgaat

SEQ ID NO: 7351 - DNA, 1200 bp, Homo sapiens
gcccgggactgggagcggctgaggcaggcgccgcagcacgccccgtgcgcccccgcgtctgcggtcgagggactgcacagagtaggttcccgggactgattcttttcctaggggacatcaagcactacaggtctttgcctgagcctgccctttgctcgcttctatcagtagaacgaggattggacacgaagcttgagcgggtccctaggtcaaggatatataataagcgaacgctctgtccgcccttctaattggtggctgggaaaacgcaggtgtgtgaacatttgctggggtccaggagtgaggataaagtgggcggcacaccgagggtgctctctcctttctcacccctctcgcttctctgagcgcgtcctactggggttgcctgccctttgaatcacagagtagccagcagcgtctcgggtctattggagagcgcaagtctggaggcgtggagtttaactaccccccaaaatcacagcctattagaagctgtttcttcacggccaatgagagggttttttgggagggacacacccactgataccatgtgggccggaactatgtggaccaatgaggattggaggtggattttttttttcaacgaagggggaggttgagttgagggtttgtaattgtaatgtacaccggagaaagccgaagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaagtaagtacagtaaatgctaataaatgactgcatttgcatagaggttatgctgttcgatatagggaaattgttaagtaggttttggatttctgtgaaagtttaatgtttggcaaataacaccttcacttttccctgtttctatgtctttttgactcttagcttttctgtattggattaaggtttctaagaccttggaaagccctttgacatgactgtgggtgactctggtacttgtattttgtgggtttgaaatgttaaatttgtaggttaagattttgtgtggaactttaaagccaaacagcagatttggctacagttgtaaggtgtaaggttgtaatctagcacctga

SEQ ID NO: 7352 - DNA, 1190 bp, Homo sapiens
aactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtatatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacct

SEQ ID NO: 7353 - DNA, 1193 bp, Homo sapiens
aaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagt

SEQ ID NO: 7354 - DNA, 1085 bp, Homo sapiens
catattgtacattattcttatcaagatcagatgagatgaaaaaatgtaatagtactttgtaaaccctaaaactctattataactgtattttggtggatgaaattgtgatgaggatgaggacagtgagtctgtgtgacttcatacttttctagccactttcatgggcatagaaaacttttttcttgaggactgcatgaagttttctatataataaggttgacaatgaatttattatactatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacat

SEQ ID NO: 7355 - DNA, 1157 bp, Homo sapiens
cacggagaggaaaggggcgagcgagaggcgcgttggggagggcgcggtggccttccgcgagtggcagggaggggcaggaggcaggacccggcgggacccacctgtacgccctccgcgccccctgcgggcgctgcccgcgcgcgtgccggggtggtggggtgggggggcacggacggacgtgcccgctgctcccatcccctccccgccaacactcgggcagcggccgaaacgtgctattttttcgctgccacctctcctgggtctacaggtttctggccccaggcgtttgtactttgaaacatttgtttaatattaagaaagctgcgtgtgcggccgtcatagtacacccggaacgtgtggccgtgagctccagggcggtgaatgaatcatcgccccgcggaccgggccccgatgattcatgcggggtacacacacgcgcgcgtactcgctatgtacctctgacccagggagagtggcccctctgcagtgatgacgcccggaggggcggggaagacttagtgcaaaaggacagcggggtcccccccttccacaataacttgtgggggggtcagggacgcccggagggacgggggagacttagtgcaaaagggcagcggggtcccctcttccacactaacttttggggggtcagggtccacacattccccaaggcttgttttgcgttctcgaaagagttacaaaattccacctggctacattaaccggttgaggagcgctggttcgctgcagggctgggtcctgtctcattcagtatttggtgtcaagtgagggaggtatcagactctgaaggaatcctcctagtaattgcgtctacctaactggttctgaagtaattagaaaaattttaaaagtggatcttaaaagaagactccttaagactagttttttgagggtttttaaaaagccagatcctaaaaggaacctcggttgccattcatgaatacagaatttttcccaatgtgatcactctcaaagattaacttgactcattcccacctcacattagtaagactgaataaagttttctcatcatttaagactcacctcaaacggcatctactcagccaggccttcttgatcgccttcattatctcctgtcccctcccccaggagccaccccataatactattttatt

SEQ ID NO: 7356 - DNA, 1147 bp, Homo sapiens
atttacccttgagcgttagaaaaagtagaatataaaggcatacgtgagaccaggcacggtggctcacacttgtaatcctagcatttggaaggccaaggtgggaggatcccttgaggccaggagttcaagaccatcctggccaacatggtgaaaccccgcctctactaaaaatataaaaattagccaggtgtcctggcatgtgcctgtagtccctgctgctcgggaggctgaggcaggagaattgcttgaacccaggaaacagaggttgcagtgaactgagattgcgccactgcaccccagcctgggtaagagagctagactctgtctcaaaaaaataataagacaaaaaaaaagggcatggatgagaggaccagagggattcccagtaaatgacaaggtgaaataagaatactaaatagtttctgagaatactgatttaatgagacaagaaaataagtcagacactttgaaaattcctactaaatgacttgaaacaagaaataacaatatgtagatgtagtatcatgtatgttgtgttttgtccttcagaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaagggtaaatgccaatgattgttatggactctcttccttacttttacttgacctttttaggaaaacctggaaatataatatgttttatttttcaagaaagcctgtttcctaacattggcctaaatattaaatagagcttcttaatttcaattaagattttatatggttagcattcatataaagactttattggcataatgcctgagaattttataatggccaaggagattataacattagtgtgatattgacttttaatgtagtaaatttttcagtttccatggagggttttttaattcttccagtttatcttgaagttattttttattaaaaatatacaattctagacgttgcatatatggatgaatgttatagtctctgcatttaaaacattttttaaatgttctcccctgactcaccaaaaagaacttatttctgccttaaatagatttaggt

SEQ ID NO: 7357 - DNA, 2916 bp, Homo sapiens
gtagttctagagcagtgttgtgaactgggagtaggtatcggaatcaccgcagttactaaaatcagacatgattttagtcttatctgatacttatgaacttagtattcatcttagacttgctgattgaaaatctgaagaactgtactcagggtaaagatgttttgagaaaatgtccctagatgattctgatctacaacagtaatttagaacctcctccctaagattaggaatacttccggaaagtctgtttatctttcaagaaaatttttgtaccattatttgaatttatctttctcttccaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccacgcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttctta

SEQ ID NO: 7358 - DNA, 1168 bp, Homo sapiens
caaaggggatatgagatatgtttaatattaaagacattaattgggactattctactttttggttgttgttcctacagctaaaatctgtccccattttttatttttgattttggacctaaggtgtcccccaagtccccagtacaaagtatgatctttgtttttaaaaaaattatgttaaaaaaatgtgtgtgtgtgtgtgtgtgtgtatatatatatatatatatatatatatatattatattttaacagatgattcagcagcatcaagagtggttggaagacttggttattagactcctttgtgtttttgcattagacagatttggagactttgtttctgatgaagtaagtatcatttaagggaggctttgcccaatcaaatttcaaattctacaaaatacgttttttgcaaatatgagttttcttcctttttcgtctgtaggttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggtaaatatttcaagttttgaagcttatgtgggagagttttttcccccttatagtttattttcactaattagacgaaatggccgtagattcttactgttacagagaagccagtcttccaagatttgccgtcttgagagagtgtcatagagataggtggcgctcataagaatttaagtataaatcaaaagatggttagttacattgtttgctctttaagttcaaagattatttttcctttttaatccattgctacagttaattcagtgctcttcatgatttggttttactgttttaactcatttaaatattgaatacatgctctgagggctatacaacatggtgccaagttatgcagtatacatacaggagtagacatcaaagtgtaaagcagacaatctgtatggtcatgtactttttacataaactgtcagtgttttttttttttttttaatcctttatgacaaagcttagaagaagaaaatgcatgtagtcttattattttcatatagggaaataagttctgaaaaattagatgccttgctgatggtc

SEQ ID NO: 7359 - DNA, 1634 bp, Homo sapiens
atcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctc

SEQ ID NO: 7360 - DNA, 1223 bp, Homo sapiens
tgtgacatctctacttgcaaggtttgagtgaaagattagtcacagattagtgaaaaaaatgtatctttttgttaaaactggcttatttgaatggattgttgcttttcactagcttgtatggtatgtcagctaacatttgtttttttttttcttttataataaccaaacttctctatctcagctgcaatagtgttccatcttaccacagagtgttttataattaatgctgttgactttataccccaaaatgggtcaagaagtggctacatgattaggggatgtttaaatttgtatgacgacaaagttaattgcaacaagtagaaaacttgggtgctaacacaggataacttctgctctttttctttcctggatatagttctgttggggtataaagtattaggtatttgtattttttgctgtcaaaataatggacttaacttttagagtgttcacagctaggatctctgtatttgtttttcaactaacaactaattttaaatgtattgtatcttttattacctgttctcttagattgttttttgctagtaacccttactcagcttctgcctttggggcttggactaatattgcttgtatggaactacagtactgtgactaaacatggagctcaatgcagctactgcttacaactgcttaaactttgtagtttggacttcatttttttctgtaataacaacttattaaatctagttgtatgaagtactgacacttgtcatccgttgcatttgctgaggaataacttggagtatatggttcacatctgggaacattggtgcattccaatttgcttaactcttttttttgacaaatccctttaaagcagactaagtacagcagaattcaccctttctctgacacaagtaacactcgtttatgaaaaacatgcaagtatatttgcaacaaagtatttgttgacacatgtgaacacacctttttagaggtgcagttgggtttttatgccagacttgctacatgaaaccaattctcaaaatcgcaaccaaaacagtggaaaggtaggtgtgccacttcgctttatctttcacacctggctctccgatttttcagaaaatgcgtcttttaaaaatccctatcgattttgggtgtgctagaagccatgtactgactaatccatttagaaaacggatcacaagtggctgcaccagcgaatcccctgcggggccttcagaacaagcagggaccag

SEQ ID NO: 7361 - DNA, 1100 bp, Homo sapiens
aggactgatagctttccagcttattttttaaactttttatttctgtgtattcttttgaaattaagcattttctattaaaaaaatagagcttaacatgcaacacctcatttgaaaaagaagtaattctaatatatgctatctgtttcacaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccaggtaaggcactgaactgtggttgtaaagtgcataccaaattgatcttgaagaacaataacatgcttttttagccatgtttgaaggtagtctaactcttctgatttattagcactaacgcactgcatttttttcctctagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttacgatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgttactccc

SEQ ID NO: 7362 - DNA, 1343 bp, Homo sapiens
cagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataat

SEQ ID NO: 7363 - DNA, 2103 bp, Homo sapiens
aaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacct

SEQ ID NO: 7364 - DNA, 1173 bp, Homo sapiens
aaaaaaaagtacaaaaaggctagaaggatgtgaggtgggtgagggagagaggcttacaggccacgttcctctctctctgcttttttttttttttttttttttgagacagggtctcactctgtgtcttggtctggagtgcagtggtatactcacagctcactgcagcctcaaactcctggggtcaagtgatcctcccgcctcagcctcccaagtagctgggactataaatgtgagccatggcactggctcccctccttctgatgagagggaacttagtgctgccaatttataattagtaagtttgactgttggtcaaagttggacatgatcagaaaagtgaaatcaatgaaatacaactccaggcttctctacctcccttttctattaatgtctaaattatcatctgtaagtgtgggcagacatagcattgactttattaaaccccaaataagtttttgaacttgctgctgtctttttgaaacttcctaggaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggtgagaggaaagtggggaaatagcagggtactgtagactttgatgaattattttccctgtaaaacattttccacattttcacctaacactgtatatcaggcatggtctacttagagagacttgagaaaaccttattacagagaatccacttctaaaagataagcaatcactatcttatggacattaaagcaattatttatgagatgatactgcatattacatacatgtcaataaagagggcattttaggtgggggaaaaggatactaaggacaagcttatgggtagcaagatgagaaatgagccatccagaggagcttagattcactaaagcctgagttccttgagggcaggtattatctctcattcgtctttatatcccaagcctgggacatacagaaggcacagcaagtgttcccagttttagatactgttaaaagtcttgaggtactggcagatttgatcaatgaggaaagaagctcaaagaagccccagtaatgacagaaaggaaccagtga

SEQ ID NO: 7365 - DNA, 1191 bp, Homo sapiens
ctcaagaccttgtcacattagagcacactatttgggtttgacatatcttccacttacattcaattcatgtttggcccagtaatggaagtatgggatgaacagctgcttctgaagctaaactatgacctttccttgtatactagaagaaactaccatcagttttcaaataaagattccatattttatatggctacctatttatgttgcttgcttatggagactttggggatggctttatagcgtagaacctaaagattccaaaagacttccctgaaaactagggataactttctgagggactaaagatatcccatagtgaaggcacttatagtccatgtcagatgctgaacaaatgtagcttggacaaagaaaaagcatgcacttttatgtaaagatcggagaggaataaaccccattcttaattatataacttcagaaaggggaaagaagggaatatcctagtaatacagtttatagagaattgaaatttgattataactggacttttgaaatgatttttaaaagatttataaaattaatgaacgcatgtctctttcactagtatatgcgatctcttaacaatttccgggctgaacagcctcaccagcatgccatgtactacctccgcttgctgatgactgaagtggcctggactaaagatgagttaaaagaagctctggatggtgagactttctacttaaagcttaatgctttcttcatttttttcctaaattcattttggtttattctgatattgactgtttatacttttaaataacttgtagttctattaaagctggctgtgtatatgttttataaaaacagtggtgggcaggatggctatagttaacagtaacatatacttttaaataggtagaaggaagatattgaacattcccaacccaaacaaatgataaataaacttgagatgatggatatgcttagtaccctgatgtgatcactatacattatatgtatatataataacattatatactctatgaatatctacaattattatttgtcaattaaaaataaaatgtaaaaaaacagtggtggctttgaagtggtttttgcattcaggcaggttagccacatttactgttttcaatctggacctacaccagttaattattactacttttagatttctgcagaagggctgggttgcacatacctgtaatcctagta

SEQ ID NO: 7366 - DNA, 1126 bp, Homo sapiens
attttactgacagttctctagctttactgttttggggaaaactcagggataagctaacattttcacaggtctcaatttttctaagttcatgtaattaccacagacacatttcccagtcctttattcctgtccaccaaggatgtgactttattggagagagagggaagacatgcaaatgctgtatctgttctgtcggccgtgctcctcccattagcctaagcacagccatgcattttggcccgttcccactgctcacataccctgcatttctaacttgtcagttctgccacaccatctggggtaggcagttccttctccttcttcactactaccagtgcgcacgcacacacgcacgcatgcacacacacacacacacactcacacacacttcaggcttctttttcagacatcttcttttttttcctcataagaaatagcctcaagaattcaaccatatcctcaggaaatcatattaaccggtgttcaatatcttgatccatctcaaaaggccatatcacattgagaagtaataaaatcagctattttactgtcaacattttcttccagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatgtaagtacccacgccttagagccttccactcatcaacattttttatattgatttgatggaagcattttttgattgagggtgtgagtttaatttcttttttttttaatctttatggctaatcatattttctcatttaatttttaagttagcttttattctaagtgttcaactacataccattcatattatgcaaattttccttgatttctttttttttaaacgtctttcatcagaatgtcatatttttctactcaaacaaaattggaccctgatttaggtttagctcttacccattctgtatttgaaatcttggtctttggcaaaggaaaatgaagtcttccttttgtaaaacctaaggttggcatatactatttccctagaaatccagatcatgaggctgcatatccatactct

SEQ ID NO: 7367 - DNA, 1137 bp, Homo sapiens
gtaggtcacttgtttgtcctaaggtgcctgagtctaagtgaaattgcacctaaaactgtaaatttaagattggcctaaaaactatgacctgcctttttctttctttctctttttttttttttttggagcattagccacatgtaacaaagtttttatagacgtaccaaattaaaaatcttaaatagactgctattgtccataatctgccttttttggtgttaattttttaaattttcactgtttatcatctctggggtagatcaactcctctgcatttacctctgttcaacattagatttttcttctgttacatagcacttattttatactccttttttcttagtagcaatggtagttttgtttctgattctgcaaaatttacatttcctatctaataagttccaaaaatctttctaaaaggctattgttttaaaatgacatctttcaagttttaattatgtttcgtacccttaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtttgtcaacagctgctttccttgacctcatttaaacccatggccactgcatagtattatattttatgtatatataaaatatatttatgtatatatttatgtatataacccatggcatatacagttcatggcatattttacaattcaggatagatttcaaaattccacatttctacttacatcctgttcaaatagggttctaaacgtttaaggagcagagcagttagagttgtgaatagatattaaccagcattccatatggagaagataatagattcttttattccaaagcctaccttccaaagtacttttttttgtaaaggctcactgtagtattgttgaatccacttgtcctcattgcctctacttctgctaatccagatgcatagcgtctgctatggggttagctctgtgggagataggacactgtagaagacacacaagatcccagctcttaaagtgctacaatctcctagagggagataagaaatgg

SEQ ID NO: 7368 - DNA, 1176 bp, Homo sapiens
gggttatgcggtggggtgagagtggtgtttgtgcgtgttgcagcagcagggggtgtaattgctctgtatacatactttaagtctcagtttttaacccctaatcttaccccttccttctaagatacctgatgccttcaagtcccacatttttccagcattctgtggggcatatttatattctgtatccctgattatagacacttaggttgcattccctcctctctctactttgagttatagtccgtcctctgttagctttctagcttctcaaatctggaacacacatgcttttcccctcataggtagggattcttagtttcagaattgagggcaagggaaaaatatttcatttataaaacaaagacaaggaatataatttgttctttgtaatttgtatttattgcttattgacacaggtatcaagtgacacttgggtatcaagtgatggtgataaatgttggaaatgagtttgtgtagctgtcacaattgtgttagaatacattttataggagttagaaaaaaatattaactgttaaactcatattaaactttattttagagtcatgagtggaaaattaactgttcaagaagagcagattgtagaattgattgaaaaaattggtgctgttgaggaggagctgaatagggtaagcacttaaaatgatatttactgttatgtgaaaagcaaatattgaaagaaaattttagaatgaaagatctaatattttttccttcaagattttttttttttagacggagtctcgctctgtcacccaggctggagtgcaatagcgtgatctcggctcactgtaacctctgcctcccagggtcaagcgattctcctgcctcagcctcccgagtagctgggattacaggtgtgcaccaccatgcctggctaattttttttgtatttttagtagagacagggtttcaccatgctggccaggctggtcttgaactcctgacctcatgatctgcccatctcagcctcccaaaatgctgggatgacaggcgtgagccactgcacccagctccttcagatttttttggaaaaaaaaaaaagattttattttgctgacccttatactgaaagtaagttatatcatgattttttactatcattaatcacatcaaaaaagctgacagcttatattaataaaacattacaagaaatta

SEQ ID NO: 7369 - DNA, 2556 bp, Homo sapiens
aatactcactcaaagccagtagcactccctgattgtaacaccaaaaaagtctctcagcattgccaaatgtcccctgtggcagcagaatcactccctgatgagaaccactaccctggagtaaaatctataactatgtcttagaaaataacacagaaaattaatatttctttcactctactccttccattagtgatcaaataaagaaggcatttggcgctacttgccaaattgttggctcaaacttgtgctgaaccttttttggttttctacacttaagtttttttgcctataacccagagaactttgaaaatagagtgtagttaatgtgtatctaatgttactttgtattgacttaattttcccgccttaaatccacagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaacctgcttgctccataatttcttatctggcaatgggtatatttagagggttaggcaagctgcattcacattcccaaaataaactatgcaggtaccaccaaagaagaaggagcctagtaaacttgcaggcttttagttgcactccaaggggctatcctaggtgcaaggttagtgagaagtaggccctcacacagcctgaagtccagctttaagtcatctcattccatgactgtttaagttatctgagaatgctgatgcaactaatttcactgcctcacagaagcaaaaataaatctccagataattttaacatccagaaccataaattagctctaccaattttcatacacaatgtcgggccctcagaatgtaaccaagagtagcatcagcaaaaatggccaagtaggtagcttcaaggaccttttcctccacagaaacattgaaaaatc

SEQ ID NO: 7370 - DNA, 1225 bp, Homo sapiens
cccagctgctctggaggctgaggcaggagaatggcatggcgtgaacctgggaggcggaggttgcagtgagccgagatcgcgccactgcactccagcctaggcgacagagcaagactccatctcaaaaaaaaaataaaaataaaaataaaccagtggttcccaattaggggagatttttgctccccacccccaagaggacatttgccaacgtctggagacattttggttgcaacaacttggcgggggggtgctactggcactcggtgggtagaggccagtgaaagctgctgaacatcctacaatgcacaggacactccccaacaagaaagaatcatctggttcaaaatgtcaattttttctcaagattgagaaaccctaactgaaaaacatatatacatacatgtttttttaccactgtttttgtttcctttccagaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttacacctggctgtttgttgtaactgtgggtcaagtgaggaaggaggcatttttctggccttgttttttcagtgaagagaatgccctggcatacctcttggccatataccctttataaatatgctgcccaattttagccagtaggtcaaactgaatataacattgtaaataaaagctaacagttggctggacagagcggttcacgcctgtaatcccagca

SEQ ID NO: 7371 - DNA, 1177 bp, Homo sapiens
ggctataagtcagggtacttgtgccttactcatctctgagctgggtggaggtgctctggtgaacagctaatgggcatgtgatgataaagttaataatataatacatcattattattatactggcattggagcgatgcactcatgtcagatgctctctaaatatttcttcacttgacacttatagcgacactgatgggagggattattatcaccactttacagatgagaaaacttagcacagagaagtaactggtctagagtcccacagctggtaagcagcagaggtaggatttgaagctaggcatttaaagcccacaggtttccctgagcaagcatatgttctcttcttgttcttatttctagtatgtactatttatcaagccacccaccaccacccaccctggttatcctgctcagatgtcctccagcagccatactacacacagcctgggaattctgtgcacagagccccagtttttgtgaggtactcagatggatcatgaagattctgaccttgcatttgtttatttaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtgtaagttgctttgactgtacaagaggcactttgctgcctctgacattggcacctggggaggcctaggccctctaccttagtgccttccttcactgagccactgctcctatcactcaggtatggatttcaatcgcaggattattctagggaatctccgggccacctcatggcccctattcacatcacagtgtgtgtaaaatggtggcagctggagcagtgctgtgcgctggggaatggcacagttagcagcccagagaccagttcccttgctccccgtcattgagcccctcctggatgtcaaggactgaggactggcaacgtttgatagcagggatttcctgtccttgggaaatagggattctttgtgccctctacttaattttgtgactccctcttcccctgcctggtatacagtgtctttccacagtatctgattaagacatagcttgcaatttctagtttatgagtttgcct

SEQ ID NO: 7372 - DNA, 1169 bp, Homo sapiens
gccccaggacaacaatggcctggtaagagtttgggtgtggggccttctcctgtagcaagataattacagtcatcagccacaataattgtcatgttctttctttctgggcgtctgttatctcactaggggaaagatactccatcaaaacaatgtattcaggaggattgtccccatggggatttatctaagagcttgcggggggcttaaggtcccctggttcatccttctcattttacaggtgtgagccaggactcccccccgccccctgccaccacccctgcacccacacaactggctgcatgccacccaaaggagagcattgctcccttgtcttaggcacggggtgccatggcggccaccttgtcatcagctgggagtgggtgtggaggcgagctgagtctgtccctgaacttgacttcaccttgcgccctacaatgatgtaacatcccgtctattttgtcccacagtgtgacccttacataaaaataacactgggcaaaaaagtcattgaagaccgagatcactacattcccaacactctcaacccagtctttggcaggtaatatacattcttaaatgtttttctggccttcatttctccacggaacatgcatgaagactctaatatgtgtccaaccctgtcctaggctctgaaactgtgtttgtgaactagataaacattctagacaggggagcaggtaataaatagataaacccaaaataaaagaacttcacagaagtgaagaagcttggttctgatagcttgcagggtagacagacagcattagtactagtgttataggagcacaggccagttggagtttttccggggacccccctcccacctggctgtctgcggagctgtttatataaaacatctcaaaaaaatctcgcaactctgaggtgctattattattcctattttatttttttttaagacagagtcttgctgtcacccatgctggagtgcagtggcgtgatctcggctcactgcaagctccgcctcctgggttcacgccattctcctgcctcagcctcccgagtagctgggactacaggcaactgccaccacgcccggctaattttttttgtatttttagtagagacggggtttcaccgtgttagccagggtggtctcaatctcctgaccttgtgatctgcccgcctcg

SEQ ID NO: 7373 - DNA, 1152 bp, Homo sapiens
atgtatatgtaatgtacatgtaatgtgcatgtattaccacttcctcaattcaggccttgtatctgggtaaatggagggaatgcctcaaaaataactatgctgttgctgggggctggaggctgtgtctctgagtgacagtgtcacactccggaaactcatggcattactctgtgatgtccatggaaattcttaacaaatgggctgagcactatcacaagaaaagtgagaaataagtcttcggggaaaattggtcaagtgctagccagataacatggacatgtgtacatggccatctcaacaattaccttccaattccagtgcttaagcagtatgtcaacagcactcagcaaaatggcttctccagcgacagtgcatgtatgtatgataagcaaatgcatgaggctgcctgggactgtgggaccttggcctaaagacttgaattattcttacaactctttccattagtagattttggagtgaaaagtgatctttaaacaaacgtgattgttttaagcctaaaagaagaatcttctgtgccatttaatgatttgattcccattgcaagtttattattagatataataaagcaagtcacatcagttgcttccataacctttccacatgaactaatgatcatgtaggcatgaataaattctcccatactaattctaaagtttaaaatcagcaacttgtcttaaataatgccttttaggccgggcacagtggcttacgcctgtaatcccagcactttgggaggctgaggcaggtggatcacctgaggtcaggagtttgcgaccagcctggccaacatggtgaaaccccgtctctactaaaaatacaaaaaattagccaggtgtggtggcaggcgcctgtaatcccagctactcgggaggctgaggcaggagaatcgcttgaacctgggaggcggaggttgcagggagccgagatcatgccattgcactctagcctgagcaacaagagcaaaacttagtctgaaaaaaaaaaaagccttttaaatcatgaactattattttccttgaaatggtttgaattgtgaacaaacagattctaaaaatctgatctcaggaaccattgagaatgtaagagtactttggaaataaaatcactctctccaaaatctcaattcagctg

SEQ ID NO: 7374 - DNA, 1104 bp, Homo sapiens
caggagaattgcttgaacccaggaggcagaggttgcagtgagccgagattacgccactgcactccagcctgggcaacagagcgaggctctgtctcaaaacaaagaaacaaacaaccatgtgtcttgaatgttttacccattctctgatgggttctatcccatgtaacccctcataaagagagttgcaccatttcataatattaagttgaaccataagaaattgctgagattcaaccactttgacctataacaacagcaatttcacatgattgaacctagtactattccctaatagtaaaaacaaaaggtagtttaaactaatttttatttagcagttgtgaataaataaagattagagatttttctgagtgaaatggatctctaagatggtatctaagtaaaggtgtgaatgccatagttaaatgaggaactatattggaccctttgcctcttactgacactatggcttacctctcttctttgtttttatttttgttttgtaagaacggcgataaagcagcatcacccagcgagttgacttgtcctccaggttgggaatgggaagatgatgcatggtcttatgacataaatcgagcggtggatgagaaaggtaacattgtacatctgtgacctgattggggctctgcagcagggccttggttaaccaggataaagtttccttgggagggaggggcctcacttctgttggtctatggcaggagtccccagcccccaggccagactggtaccagttcatggccttttaggaacaaggccgcacagcaggaggtgagcggcgggcaagtgagcattaccacctgagctctgcctcctgtcagatccgtggcagcattagattctcctaagagtgcgaaccctattgtgaactgcacgtgagaggggtctaggttgtgtgctcctcatgggaatctagccatcctccctctaccccacaaccctgtccatagaaaaattgtctcccatggaaccggtccttggtgacagaaaggttggggaccgctggtctgtggcatctgggtcatgtggtaccgtctgtgactaaccaaatgtagaatccaagggaaaggcaagtgtatggacaag

SEQ ID NO: 7375 - DNA, 1475 bp, Homo sapiens
ccttctctataagcaaaaatagttaatatggtaccctccactccttgtaccattgatttgcctggaggaatattcagaagacagcatctactgtgtatttacaattaccaagattttttttgagctcttatttctatagtttgtatcatgaaaacagtaggcttcatttttttggttatttttcatatttgaaacatacaattataatatcaagtatacttttcctaactgcacttgcattttctccccgttttgtttgagaggcactagcgtcatagaaagaacaaggatacagaaatagacatgtgagttcagatcttggttttgtacttgccagctctgtgactctgaacaaatttgttaacctttatagccttagagacaatactagacttctccagacccctgttctaaatcttagtttcttttttttttttttaaacatataagctaaacctgagtttccacatcagtaaaatcaggataggaatagtgagaattaaatgtaaatatgtatgtaaattgcctcgcatagtgcctagtatatagtaggtgttcggtaaatggttacttattgatcagacctttgattcttttggagatttggagattcgaataatactaacattaatatcatctataggctgggcatggtggctcacgcctataatcccaccactttgggaggccaaggcaggcagatcacctggggtcaggagtttgagaccagcctggccaacacagtgaaaccccatctctactaaaaatacaaaaattagccgagtgtgacggcacgcatctgtaatcccagctattcgggaggctgaggcactagaatcgcttgaacccgaaaggtggaggttgcagtgagccaagattgcgccactgtactccggcctgggtgacagagtgagcctctgtctcaaaaaaaaaaaaatcatctatagtagaaaatctgtagctttcaaatatatctcagtgctgttaaggatctttctctgtactttatttcccatttaggggagatagtgatcagacctatacatttatgtgtattttcatagatgggcgtttgagtgtttctgcagatgagttcaaaaagttgaagtttttctagagaatttccacagagctgaaactcataaaacgttacagtcagattcaaagtagctgactaaaatttttctttgaagttcaagagttagtttctccacttttggaatgtgaaatacaaacttggtagaaattataatttttaaaatttttatttattttttattttttgagacagagtctcattttgccacccaggctggagtgcaatggcgcaatctcagctcactgcaacctccacctgggttcaagtaattctcctgcctcagcctcccaagtatttgggattacaggcacctgccacgacgccctgctgatttttgtattattaatagagacggggtttcaacatgttggccagg

SEQ ID NO: 7376 - DNA, 1137 bp, Homo sapiens
ctcttccccagtggctgtagctcctagcctaacaatgtctcctaagtagggctaccttataacttcaagcagaacttggagagacaccatttagtctcagaatgtattataaatggtgtaaagcagagatttttagtatattccaaaccagggaatagctatctctttcccttctccttcttcccccttaaaaaaggtggatagggaggagtaattctaatcaacaacttcttaagctgctcttcattcacctatacctcagcgttggctttgctccttggataaaccaaatcctcagccataagctgcctcgtttattaacatttcatggtgcttaggtgaattcttgctacgatggtacaataaatattttcttcatgtgctaataaaaaaatgtgagcatccagtcaagagaactagacagtctgtatcagctgtaatggtcttgttctgggccttttccagatgcaggcatgtactttagactttgaaaatgaaaaactcgaccgtcaacatgtgcagcatcaattgcatgtaattcttaaggagctccgaaaagcaagaaatcaaataacacagttggaatccttggtgagtctggaatgattaaactaaaatttgtcttcgtcttccatttatataccaaatcagttccgaacttaggaggatacagcttaacacacagctagctgtatctcaaatcagtaggtagagcctctgcctcatttgaagcaactgccctttgagcatcaattcagaggacatgaaagagggacatgatcacatctggaaacattcccccaactaccccagctgctgtgatgctggaggcactaaatagtgcctgagctggggtcaaaagggtagaatagagggtagtcacagaatcctgaactgaaattgtgtttatctattaaaaaagaaagaaaggctgggcacgatggcttatacctttaatcccagcgctttgggaggccaaggcaggcggatcatgaggtcaggagttggagaccagcctgaccaacatggtgaaaccctgtctctactaaaaatacaaaaaattagccgggcgtggtggcgggtgcctgtaacctcagctacttgggaggccgaggcaggagaatcacttgaacccgg

SEQ ID NO: 7377 - DNA, 1755 bp, Homo sapiens
ttgagaccagcctgggcaacatagaattaattttttgtagaattttctatttctacaaaaaatagaaatattatctggacgtggtgacatgtgcctgtagtcccagctacttaggaggctgaggtgagaggattgcttaagcctgggaggtcgaggctgcagtgagccatgtttgtgccactacactctggcctgggtgacagagtgagactgcctcaaaaaaagaaaaaaaaaaagctgaacattggccctatttacaaattctattatttgaaacttatttttcagaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaatatgtctagtgtattcgtgtatatatagatattctaagattcttgtttaaaaaaacaaatgtgttggacataatcaaaattcaagattttcacaataaaatatttaagacataattcaaagcacattatcaaaaaagtgaaaatacaaccaacagaaagagaaaaaatattttcaaaccatgtatctgataagggtctagtatccagaatatataaagcaccattacaactcaataaatagatattctaagattcttacccccaaggacttatcaggggttacagattaacactcagtgtaagatgataaggcagttaaggata

SEQ ID NO: 7378 - DNA, 3352 bp, Homo sapiens
ttttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattctagtttatcagcatgatgttaaatgtcagtgccataccatgatgcagcaccatgacactaacgccatgaattcaaacagcacgttttacacctggaacttcatcagaccaatactttgcagttagagagaatttaatatctagaaaagcttgggaggttagtcaggacttagggagtatacataaatggttacttgttgtaatgagccctttattggtgaggttgcaatagcttccagctcttactgtgtcagatgaagcatctgtcattatcttaagcctgcagagttgaaaggttataggctctttcctaccctctcatcataatttttccaaagcaaagaggaacttggcttctggggttcgtgccttagtgagaaagaatcttttccaatagttccaatgggggaatttttggcttgctgattttatcaattgccttgacacctgacaaaccctaaatgaagtctatgtaggtgagtcatctctgttccacctgatttacagtattggaatttagacttgcaaaaacatcattctgcaaatatcttagataattacagaatcaggagcatttgagaactctagaggtctcagaaatcatcacataggggccatgcttcgtagatagggatgatagagaggagacctgcccaagttgaatttccatggccttcctcccttccttagttccatgataaagtatggacagtaaaccactacttgagctacctaaggtgaattaactctcagggaaccctcttccagttctttaccttgcacagtgaaagaatcagtggcacctagaaagttaaatccctttaggcccatacactagagacatgttttgtttgaacaatgtagtttaagtacttgaatgtcacactatataactgaggttagagaaaatgtttcttctagcccttacagggtgtgattcttaaacacaatgtccaaggtgtatacaaggatatgtattgtaacaactatgggtatgtatattttgcagagcgtagtttctatatcttgaaaaggaaaatattttcataaattgtttttataagtactaataaaataatatgaaagaaagctatatgttggttgttatgattatagcaaatatataacttatttccctttcaaccctatgcttcaaaatatattttctgtaggagattgacctctagccattcagctgggatataatctcaaagtttaaactgtctgacccacttgtactatcaagagggtcagatgaacagtgtaatctgtttatctctccaaaataaaggcattagtcttctgtgttagtgagaccttcattcttctagatcctgagaacttaaagtagctttgaactctgtactttttgttcctgtagctaatccgttactaaatcctgaa

SEQ ID NO: 7379 - DNA, 1142 bp, Homo sapiens
tagcatttctttccataatcacaccattagaatgaagttttcacctacttcacaaggttgtgaggcggtaggaaaaagatctaagcgtgttgtatattaaagtgcttggcaaacactatttaaacctccctgcaagtataacttttctcctcttactccatgctctaaaggattcagagtgaggcacctggaggaaaaacagacacaaaactacagaggaggcaacaaaacaaaaccagaggcaccctgttttcctttcataaatgctgcaagcgcagtcgaacccgctatggaaacccgacgctttggtttgcctttcagggtgctggcatgaatgaataataacttcattttcaacttgagattagataacttttatcaccaacacctacttcattttatccctatgttttaatagaataaggaatagagaatcaatttgttggtagaccatgctgagtagcttagcttcagaaagatttagcaccaaattataaatggtgacactttaatagtgagtgtgatgtgcattgggagccagcctgtgggagtttggcagttggaaagccccatagcttcattttttccagatttttgtacccttccatcagatagtaactccttagccttgagaaactctcttccaggacaaggggaaagtttatttgagttctaaattgtttaatagcaaatgcattatttgtctctttaatgagaccaagaaaatggcttcagaccctggttgaaccagccagttctccttttgatggccacaaaccaaatatgggcagtgtaatgatggtatgactctggcctgactaatatttttgtgaggagaatgccattattatggtgaccatattttccaaacaaaaaattgggaactttttattcagaggaaagaggggcagaatatttgaaattgagactgacccaggaaatccagaatgaatggtcttggtagctattgatcacagcataaaggaaaaagaatgtgaatgaaccagtgcaaatctaattggttgctagaaaagtcaggagcctcaaaatgaatgacttgctagtggtggcaaagaatcaccatctacatgcaaagaaaacacattagatgccctgagaatccagtgactgtttttctcaga

SEQ ID NO: 7380 - DNA, 1194 bp, Homo sapiens
gttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctattcttgtgatatgataattttttgaaaaaagcacagcagtccaactaaagagatctcttactgtttgaaagtcatagcagccagttattttactctggagcttagagttcttttttcacatgaagtaaacgaaagtagaaaattcctttaccattccagcagagtgagaggatatgagcttaacagtgtatgtcagtcttttagcatattatatatgatttttaaaagtggttctgaggtcacattttttaaggcttgattatttaatgagaaaggtatgattcagcatatgaatatttgctttt

SEQ ID NO: 7381 - DNA, 1135 bp, Homo sapiens
tctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaat

SEQ ID NO: 7382 - DNA, 1154 bp, Homo sapiens
gtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatcaactatatggcaaagttgaaaaaaaaaaagcaactgtaaatccgcctacaatctgctgttaacatttgactatacctttttaaaaacacatt

SEQ ID NO: 7383 - DNA, 1314 bp, Homo sapiens
cgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgtaagtaatgcacaatctgtaatagaacagcataaaggccaaaagaggcacaatttagaccctgtgtgaaaggatatcagacaatgaggaagagaaatcctgaatgtaccctggagaggggacatactccataagccatacatttctgtgttagtgtttatttcatggaaaaatattg

SEQ ID NO: 7384 - DNA, 1143 bp, Homo sapiens
atgaacatgtaaaatgagaaaaatcagggctgccctgttgaagtaggaggggtttttggaaaaatgtctctggaccctgggaaggagaagcaagtcccttatgattggaggccagttgggaggccctggtttcccctgtgatgggttcctggggagaagccccaggcccctgctcaggaaggatggtgccacctgctcaggtgccacctgcaggtgcttgtcactgatggagtcccttccctcccttgcttctgtagtggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttttgttcagtgtcaccttgtcagcaacactgtgtcccttcgccccaccgttcttctctgctgcatttggacatcagccaaatttgaacccaatcaaatataacgtgtctgacactgattttgtttttactcaataaatgtatagactacaaagcagtgtggtgtctgttatctgattatgtgtcccatttcctactcaagcctgatgagatttctgaggcctgtcttcttgttttgggtttcttgtttctctcagatttactggcctttcccccgcaacttgcatcttaacaagctctgttcttacatttcttcgaagcttgcttgaaatcctctttctgtaaagctaatataagatacctagctctgttttttttttgtttttggagacggagtctcgctatgtcgcccaggctgaagtgcagtggcgctatctcggctcactgcaagctccacctcctgggttcacgccatcctcctgcctcagcttccggagtag

SEQ ID NO: 7385 - DNA, 1181 bp, Homo sapiens
ggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggcatatgtttgttctggtcattcattgtttctttcctccctttgccaagcttctcaaatgaagcttaaattcactgcttcaatttcttataccctcctttccatccttaatcatttaccatctgccttctgccgcctccttgaagacaccacttcttaccttacttttttctcaataacctaactcctgaccctctgaattaattgattactgttgaccattttgccattatttctaaaatatgttcgtatttgttctgataacaaaagtgatgcacaaatgtctttaaaaacaaaagtaaaacattataaaatatgtataatgggtctagatttgctttataaaacatgggtatgggaaatgacatagcactttgtttttctaaatcaaattaatctggctatgagtcctctcttggtatgggtgggcgaaaatgcaatctgtcctttttctcctccaaaccaaatgtgttaaggcactaggcatgcagtctcccctggcatcccgtggctacaactactgcca

SEQ ID NO: 7386 - DNA, 1222 bp, Homo sapiens
gacatttcacaattaccttcatttttatttgagatcagagaatttcacagttaacaaatgttcttcctttttttgaaagaaacttaattactcatcacagcaggtacatgtcttgcctctatgacagttgaaagaggcaaaaatatgtccttaataacagtgtgttccagtgctgaggtgagagtgcctccaggtatgacagctagtggatgttggaggtcttaggtgagatattgagggaaaggaccaccatgggccagggacgctgaacaacccatgcatctttatttgagctactctttgtagagaaaagctggcctgtttaacactacctggtcagctcctatgatgtggatcaggtgctcctgtgacctactgagacagatcccagtgggatggccactggtgagtttgcaggatgctgggggttggaataggaaggaagggcagtcagttaggtaagcaggcccaggattagggaaccagatcagccacaggaggctggctgtctagactcccctgtccaaggggacacagtgacattctgagtcccagaacctgaatcccatctggtaggcaggaagggctctgtagtggaagtcctcagggaagcagatggcatcaggtagcaggacacttatgtattcaacaaatatgtattaatgcctgctctgtgccaaggcactgttctggggattcagtggtcgtaagatagactgtgcctatgcctccctggatcttagatttgagtgggaatgatacataagaatgtgagctccatgaggacaggggtctttgcttgtcttgtcttgttcactgttgtatcctcagctcttagaagagcacctcacacctgatgggtgttcactaagtattgtgagcaatacttatgaaggaagcaaacaaataactaaatagacaatataatttcaggtggtaatgagtggtatgaaaacagtaaaacaaggtgaagggctggcggggctctttttgaaagaatggtctaaaaaggcttctatgtatgtgagagagaaaaagaaggagattggttttgtgcagagacctgagtggagtaaaggaaccaggggaggagaagtgttcaggcagagggaatagcaagtgaaaagaaaggcctttgacgtaggataagcttggcttagtagaggagcagtttggctggacttgggctggggggtgttcatagggagggagagtgatgtga

SEQ ID NO: 7387 - DNA, 1353 bp, Homo sapiens
gcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcctgtgcgtgattgaagttttctcccttaattgttgttacccccttccttttcctctcttgtgaccctcgtgccctgcttgtgggcatggtctcttctctggaagctgtctggggagacaagacatctgcctcaacagtgtttgttggtggaagcaacataggcagtccccacagagggactcagacggagagacaggaaaggaaaacaggagattaagccccaagagcttgaagactaaaagtgcagtgaaggtctgaagttggtggggtccaacctgagcgagctcccgcggtggcacatagccccagctgacatccttagttcactgcatccccccagctcctccctgccagtcctgttgcctcaggatcacttgacagct

SEQ ID NO: 7388 - DNA, 1172 bp, Homo sapiens
ctttatggagatgtaattcacataccatacaattcacttatttgaagtttacaattctgtcctggcgtggtggctcacacctataatcccaacactttgggaggccaaagcgggaggatcacttgagcccaggaattcaagatcaacctgggtaatatagtgagtccctgtttctacaaaaaatagaaaagtcagctggacatggtggtatgcgcctgcggttccagctactcggggctgaagcagaaggttcacttggagctgggagttccaggctgcagtgagctgttatcgtgccactgcactccagcctgggtgacagagcgagaccctatctcaaaaataaataaataaataaaagtttacaattcagtgatttttagtatattcacataattgtgcaaccaaaaccacagtcatttgtagaacactttccctttcatcacccaaataagaaattccataaccattagcagtcactccccacttctacccaaactccccatccctaggcagtctccagtatattttctgtttctatggattaacctgttctggaaattttatttaaatggcatcatatactatggtggccctttgtgaccggcttttttcacttagcatgttttcaaggttcatccattttacagcatgtatcaatacttcatttgtttttattgctgaataatattccactctgtggatgtaccatgttttatttatcagttcatctattgatggacattagctgtgaacattcatgacacgtttttgtgtgaacatgtttttatttcatctaagagtggaattgcagggtcatatggtaactctgtttaaaagacttttgaggagctactagactgttttccaaagtaaggccccttgtaccatttcacattctcaccagcattgtatgaaggttctaatgtgtttacatcattgctgttattcagttgtttttttttttttttttttttttgaggcagagccttatcctgtcacccaggcaggagtgtagtggcacaatatcggctcaccgcaacctccacttcccaggttcaagcgattctcctgcctcagcctcccgagtaactgggattataggcacctgccaccacacctggctaatttttgtatatttagtagagatggggtttcaccatttgggccag

SEQ ID NO: 7389 - DNA, 1081 bp, Homo sapiens
aggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagag

SEQ ID NO: 7390 - DNA, 1208 bp, Homo sapiens
aattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagattt

SEQ ID NO: 7391 - DNA, 1159 bp, Homo sapiens
atcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataatttttttactgtgctaaaatctgatggaaattttgttctctaggaaatacagattttaaagtgtatgtgttttttcaatgctagttaactctacaagatagataaaagtgtgggattttttttcttcccaaaatcatagatgatatattgtttaagaaaggtaacatataccataattttactatggttatgctggcaaggtgagccatagagaggcttatagtcttcagtaccctaacagcaataaaattaaaatgctctgtttgttacatatagatctgttatgagacatcacctgctgtaaatagcaaggagagagaaggaactttcctgctaatattcgcagcactataacattacatttcagaatagccatatcaggaaaataatgtcgagatatgtacttcttgcctttaagttttaac

SEQ ID NO: 7392 - DNA, 1104 bp, Homo sapiens
acattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactatcaatcaaggtgttatatttcagtcagaagtgaaaatttatgaagagtatttg

SEQ ID NO: 7393 - DNA, 2217 bp, Homo sapiens
tattcttgctttataagagatgtattttaattctgtagttactgattatacaagaaataattgctacttgattagacttggcgtatgatggtcagactcagtgtattatggtatcaggtgatttgcaaagcaaatgatacagttttagtaagttcagagagaatactaacataaggatattttctttaaaaaagaataactttccagagcatagagtatttagtgtttttaaatgatggatactgctctgtatgtatttgtttcaaaacatcttattttatctttgcaggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatctattgatggactctacatcctatattgtgacatgtaagtcctttaaaagg

SEQ ID NO: 7394 - DNA, 1557 bp, Homo sapiens
aggcgggcgaatagcttgaggtcaggagttcgagacctgcctggccaacatggacctggtctctactaaaaatacaaaaagtagccggacgtggttgcaggcacctataatcccagctatttgggaggccgaggcaggagaatctcttgaaccagggaggcggaggttgcagtgagccaagattgcaccattgcactacggcctgggtgacaggatgacactccatctcaaaaaaaaaaaaaaagtatgaggtagacctggcacggtggctcacacctgtaatcccagcactttgaggggctgaggcgggaggattgtttgagctcagggttcaagaccagcctgggcaacatggtgaaacactctctctattaaaaaaaaaaaaagagctttcccaagcggctgccgaagatggcggaggtgcaggtcctggtgcttgatggtcgaggccatctcctgggccgcctggcggccatcgtggctaaacaggtactgctgggccggaaggtggtggttgtacgctgtgaaggcatcaacatttctggcaatttctacagaaacaagttgaagtacctggctttcctccgcaagcggatgaacaccaacccttcccgagtcccctaccacttccgggcccccagccgcatcttctggcggaccgtgcgaggtatgctgccccacaagaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctaaaaaaaaaaaaaaaaaaaaaaaaaagaaaaaggaaaaaaaagagcacgagggaactagagactaatggaaacattctatgtcttggctatagtggttattacatgtaatacaaatttgtgacaattagtcaaagtgtatactttaagtgaatgaattgcattttatgcaaaatattcctcaaaaatgattaaaaatagaatacataagcaagaatattaagaaaaatgtggaaagtaaacaaaatcaggtggttttgattttctagctattttaatttgctataatttacattaaaactgtgcaataggccaggggcggtggctcacacctagtaaccccagcactttgggagtccgaggcaggcggatcacgagttcaggagatcgagaccatcctggccaacatggtgaaaccccgtctctactaaaaatacaaaaaattagccaggcgtggtggtggacgcctgtagtcccacctattcgggaggctgaggcaggagaatggtgtg

SEQ ID NO: 7395 - DNA, 2300 bp, Homo sapiens
cggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaag

SEQ ID NO: 7396 - DNA, 1139 bp, Homo sapiens
tgaaagacacctattcacactctaattaatcatgggagataagcatgttaccttctgcaccttgactttgctcgtgagcacctggctttcctcttcctccttctcccctctctccctgtctcagtgtgcatctgtgcagatgtgggccagtccccctgtaaccagtggttacagaatgataccatctgttctaagatgtggtcagctttacttctcaggagtcctgtcctacaattcagagcacccctagatgggatggaaccagtgctttatgatcatgttcctcttctctgtgccctgtccttcggcacccccatgttagtcatgatcctcattgtgcagggctggctggactgagaattgcaactccaggacagcagggagctttgggactaggcacgcaggggttttgtcatccatttgaaccataatttgcatattttcttacggcctccctttgtcttttctaaacaaatgaggcagacacttgaacagtaatgctggagaatgttttttctaggagactttgtaagcaaatctgattttaagatgaaatgtgaatgagaaactaggtgccagggaatttagcactgaactagacagtcaaaacttttttaactttgcaggaagaaataaattttgctctcgtctaaatgttcacaagaagtaatgttgtaaatagttttctaaaaatatttattacttgtgctgtatacaaattcatgttctgagtgatgttggtttgcattgtagtattatagaatatattttgagcagtggacttcctttcataacacagttcacacatggagaaagaacaaaaaccagcaggttgagagctgtttggggcctttgatctgtaatgttacatcaaatctgagctttaactgccccctcttctcatctggttatgttatattatatatatatattatatatatatatatacaggtgtatgataaactggtcagtggtcagtactcagatctgcagagcagatttccagatgttctttctgatgtgttgcccataagcaataagatcctaggtaataacatttattccagggcccacattggcccttgtctcagaggatagggtgggggtagaacagctcttgctaagacctcttgcctttg

SEQ ID NO: 7397 - DNA, 1145 bp, Homo sapiens
taaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgtaccaagtctcttaaatattgaaatcttgtagacttcttgtgcttctgtgttttgctttcctatcaggccatgtaggaaactgtgttcttgttattggtagaggggccctcactgaaatccaagcttggaaggatgtcctgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcaagtgtgtctgtgtagtcactgaagagggcacagaacgccttgaagccgggcattcaacttgcagcctaaggcaaaattgatgagttgccagaaggaaccacaaagcaatacttccaccaagtgtcagggcttagagaaaccttgtttgctaatgtaagtaataaatcattttgtgagttctgcctaacttcagggaaaagaaaaggcaatggaggaatccttgagattcccatggcagggttggaaaggtgccagcatttcatcctgaggggcagggagcaatggagggcaaactcctgacctcaggctagccactgggaagtgtgcaggccacaggcca

SEQ ID NO: 7398 - DNA, 3517 bp, Homo sapiens
acctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatccagaggatttgactggtctattcacattttgactgttgatgttgaagagagagtttttctcttgttctgaggaaagtgaagcctctagaaaggctcctctttggcttgtttttaggtgggtgggtgggttcaggaggagcggggcttttggctgataagaagtatgatttggagcctctgggatcctgagcttcctaatttcccatggctgagtctagaatgcttcaca

SEQ ID NO: 7399 - DNA, 1228 bp, Homo sapiens
tggaaccacgtgaggtctgcctagttcatgtgctggccaccacctggaggcccccttctcatccctgctggcgctgggggtgagccatcatttggcaacaggagggggcctcctattctcagccagatgtgacccttccgttccttggccctgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgcattttttttctagaaactgtttcatagtctgccccctccaggggtaagaacagtgtgcagttgttggcagcagtggcctgacctcttcctgtctaactccttacatccagtccagggcatatcataaggctttgcccataggacaggctttggaacttgcccgggagcacccacctgtgtcaggaggggcagcgaatgccccagggctggtgtcgggagctgcagttcagcaccagggactgccccagctgtcctgggcacaagtctctccagcatctttgttcattgattcaacaaagtatttgctgagcccctctaagtgcccagcatagccttgttcattcacctccgtgtcttcccacattctttttttcccagacaaggggatctgtttgtgtaatgtgattcactgggccagctttgttggtctggagcagagaagggcatggcacagaagtcctgaggtcactgtcctgtcagcccaggtcccctcatgtggatacaatcccacaggcagccagaagcaaagaaccccagcactgttcccacaccccagtatgagtgtgctttgtgccct

SEQ ID NO: 7400 - DNA, 1195 bp, Homo sapiens
catgagctcaggccactggagtgagcactgtccagagctgggtgagtggagtggattggtgggccccacggcacacacccccaacccctgtgcctcgcccaggagttagccactcgctgtccacattccactggtcctctgtcaagccacatgagcccccacggacccctgctcagaatccctccagtgctgggggatgctccgtggatagcattggacagggagtgagccccaggcctccctcaccggttcctgtctgccagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagagggtgagggctctagggccacccgctctgccgagggagcctgggcaacaccaggaaaggagccactgttgaggcttgttgggtggaggtagcattgaggggtcctgactggtagccctttgcccacagccccgtttgaagtgcctcctacacatcgtgaggaagctctcagctgaacacaaggagttcatcactgccctcatcccagaggtgagtgtgcgggtgtgttttagaggggggtccctggaatgtggctcttaagggcctcaggatccagggagggcagtgatgggagtgggaggactcgattcgcttcccgggcagatggctcagggagcagatgctgatggagttgtcttggccaggtgatcctgtgcaccaaggaggtgtcggtgggcgcacggaagaacgcttttgcactgctcgtggagatgggccatgctttcctaaggtttggctcgaaccaggaaggtgaggcccagggggctgggggtggacactctgctcatagactgggtggggggaagcacccctcaaaaaaggtggggagagctctgtgccctggccctgggcaggctgctcctctctggccctcagcccccctacctggtgggtccttcctgcttgacccacgttggtctctgtccccagaggccctgcagtgctacctcgtcctgatctaccctggcctggtgggcgcggtgaccatggtcagctgcagcatcctggccctgacccacctccttttcgagtttaaaggtaaatgcttatttcct

SEQ ID NO: 7401 - DNA, 1252 bp, Homo sapiens
actgtgggcttctagatcccactttggtagagatatctggccatataccttgctgtagtttgttggtggtctatcttgtataccttttcttgcttttcagtttaatggctgagaaataagtatggtgggggccattccctgggttcagaactactataaagatcagaaagggtgtcttattttaatttctgtcaaagtcctttatcacctggaggacaaagtaaacctggaggggtgatgtggatttatgtcttgtgtggctgatgatggtggatgttttcaggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcac

SEQ ID NO: 7402 - DNA, 1219 bp, Homo sapiens
aggatgttatagagtctgttgtcttaagcagagaaagacatctaaatggtgtcaggacatttcagtacttctgcttattgagtacttactgtgctaggcactgagtcaggtgctttacatacgtccccttcatttaggtacattgtgatttaatgaaaatttgaggacacgtggtgatacagatagcatgtgaggcaggcatggtggctcatgtttgtaaatcccagcactttgggaggccgagttgggttgaagtcaggagtttgagaccagcctggccaacatggtgaaaccccatctctactaaaaatacaaaaattagccgggcgtggtggcacatgcctgtaatcccaactactcaggaagctgaggcaggaagatcgcttgaaccctggaggcagaggttgtagtgaaccgagattgcaccactgcactccagcctggacaacagagcgagactctgtctcaaaataaataaataaataacatgtctaaaagtatttgatacacatcactgatatagtgggtactccaggaaatgttaaatctgaattgaaaagtgggacagagtactgtcatatgaggtggccaggaaaggattagtgacgtgagatcaaaataaattaaagaacataaaagtaagtgaagatattcaaggcagagagacaagcccaggctaaatgcagaagcagaaatgaaggcgtaagtttggggatgaggaagggatgagagttaagcatggagaggttgccgacgaaatatgagtctgagatgtcacttcttgagatgttattcaggaagcctgtgtcttcagtatttagtgaccgtgcgtaatgtgagctttagaatcagcccaccttagtttctatcctctacttcctaaccttgaatattagggtttctatagttgaaaattttagagattgagatcattgtagatccacatccaggtttttgtttttattcttgtttttttttgagacagagtctcgctgtcacctaggctggagtgcagtggcgcgatctcaactcactgcagcctccacaccttcccagtagctgggactacaggcatgcgccaccacgcccagctaacctttggtagagatgaggtttcaccatgtcggccaggctggtcttgaactcctgacctcaggtgatccacttgccttggcctcccaaagtgctggcctcccaaagtgctgggcttataggcatc

SEQ ID NO: 7403 - DNA, 1197 bp, Homo sapiens
cctgcctctgtattggcagcaaaagatcaagctaggaccagggctctgtgcttctgacccttggctctccttaggggaggtgagctctgtgttagactctggctgctaaccagttggagagatgtaggactgctctcttcttaggctttaagaagccctgtccaactcagtggtgtaggtacttgagttctgctctttagcaaggaggcgttgggagctcacactcctgaatctgcctaatatcagacgtaggcaagagagctgtgagcccaggctcagccaatgcttatctgctctgcgcctccagcagggtggcagcactggaagcatcaggaaccctggctgctctctaccctgtggccttcagcagccacctcgtacccaagctcgctgaggagctgcgtgtaggtatgtgtctctaatcctctgtggcccatccctttccagcaaggctttggggccttcgtgcttcctatcacacagtaaacctttgtctcatgggttgctttcaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagaggtaactactaggaataaccaccaacggactgggctgaatagggagctgtagtctctaaggcagtggttctagctgtagctatacataagagtaacagaatcaactcttttaaaagaaaaaaaaaatactgatgcctgcgtccaactgaatcagtctctgaggagggatgggacttaggcaacagtactattaagagtacccggccagggccgctgctcttgcctgtaatctcagcactttgggaggccgaggccagcagatcacttgaggtcaggaatttgagaccaacttagccaacatggagaaacccagtctctactaaaaatacaaaaaattagctgggcatggtggcatgcgcctgtaatcccagctactggggaggctgaggcaggagaatctcttgaacccacaaggcggaggttgcagcgagctgagattgcgccactgtactccagcctggccagcctgggcaatagagtgaaactctatctcaaaagaaaaaaagggttgggcgcagtggcacatgcctataatc

SEQ ID NO: 7404 - DNA, 1153 bp, Homo sapiens
ctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcctatacctagttttcctgactttctggccctgcgtcttcatgaatatcaacccatttgctgtttgtaaaagttaatcgggttagcccttggaactgaccctgcacactttatcaagtcatctaattttctcagcctctacagaggaggacgtatgaacttttttttcttatttaaatcagacaatctcaggctgtcccaactagtaggtagcacagctgggtgagatttgtaaccgagcctttctgattccagctccctttactggacctctctcaccctgagcatcagagtacttaagtcctgagactagttatggccacacctgctgggttacctctggcaggtccactcctgccggagtttccctttttctgcaacaggagagtggtggaacattgacccccacgctaacccttttacatgcacgtccttgttggaggaaggtactattattatccctgtattacagatgaggctcagggaagttaagcagtttctccaaggtcccatagacactaaggggcagatccc

SEQ ID NO: 7405 - DNA, 1380 bp, Homo sapiens
ggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagag

SEQ ID NO: 7406 - DNA, 1175 bp, Homo sapiens
cttatcaaaccagtttaatagcatgacttatgacatctgccatgagtacaggatgaggatgaagaaatgttgagttttgcacaacctgatctggtccaaccctttctactgcagagaaatctgtaaactttgtctagtcagacagttctcagagggggaaagaccagagcagagccccgctctcattttgctccaaatcatatgttttatggtccaccatgacgaaatctcttgaagtccccattccattcttcctattgatgttggctaatcatacacttgttctctgcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaagagctgtgtgagtctgtcacagaaggggaggaaatgaaacagagtgggaggggcaagagtgtccccaggaaggaaaaatcagggctggcctcctctctccttttcacctccctctcctttttcacccccatgctgagcccctggaccacagcctccttttccagagtctgttggatcgggagtaaagaggggagtctctgcagcagtcctgatccataggatcaggagaagggggaagactgtcatggtcagcccagcacagtaggctgaggccttgggct

SEQ ID NO: 7407 - DNA, 1198 bp, Homo sapiens
gctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgag

SEQ ID NO: 7408 - DNA, 1566 bp, Homo sapiens
tactctatatagtagggtatcaatacatgttagatactgttaatgtagctattttttaaattgtggtaaaatatacataaaatttaccatcttaaccatttttaagtgtatagttcagtggcattaagaacattcacagctagtcgcagtggctcatgtctgtaatcccagcactttggggggccgaggcttgagactaggagtcccctcagccccaagtgctggtgcagtgagagcctggggtgagacacttggggtgctttggaagccctttgactttggttctcctgttgcaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttggtgtgtgtgtcttctgtcctggtcctctgtagcgtccctccatgtgaggtcctcccattctatctcattgtgcctcacgccctgctgctggcctcctttctgcctctctggcttcctctttccttctaggagggaaagagagtgagttcacagatctctagtgcagttaggagcttgggccaggggttgcctgaggacagaaaccagagggaagaaaactgcctgtgtccctgatggaggctggagggaattccagaggcttttgtccctgctctcaatgggccctctgttagggagctccactgcctctcatt

SEQ ID NO: 7409 - DNA, 1238 bp, Homo sapiens
tgcaagatactaccatttccattgccctttcttctgttccgagagcctggctgtcgacatctgagctgggctctgggaaacaggtttgctgagtggcctgtgggcggccccctttgttctcttttttttttttttgagacggagtctcgctctgtcgcccaggctggagtgcagtggcgcaatctcggctcactgcaagctccgcctcccgggttcacgccattctcctgcctcagcctcccgagtagctgggactacaggggcccgccactacgcccggctaactttttgtatttttagtagagacggggtttcactgtggtctcaatctcctgacctcgtgatctgcccgcctcggcctcccaaagtgctgggattacaggcgtgagccaccgcgcccggcccccttttgttattatctccccacctggcttctttgcacactggatggacttcctcctggttctccttggagcctcagcagactcggaagcctaccctcgtaagaaacccactgctgccaagccagaattctgagaggcggaatcctcttctctccctaagactcacgaaagggatgcttgttgccagggaagatgcttgagtcccctcctctccctcatgctcacagaagatgaagttggagcttcatcttcagcgggaggagggaggtgcaggatcacgtggaccaccggagaggaaaagcccctctctttaaactggagtcttaagaggctatgcttgagatctcaccagctcctagctttacctggtgaaatgagcctgcattctcaagacttgttctggttctggataagaccagaggaatatacttacatacattgtggttatagtacaagctctctggacttttgtttgaatgcgggagtgggtagagagcttgagaagtggcattagactatgagaaacaggaaattgtccagtggggcttttatgagccccaccagatggctgacccttccccctctcattgtaatggtaaggacacaggcttagaatctggtctccgcttgctggcttagagaccttaaacaaaccacttaacctctgcaagcctcagtttccttctctgctaaatgatgaggctgacaaccatgtgatgagggtaggggagcgaagctggagggagacagtctttagtattcctctgcccttggttagaggtaaagaggtattcagttggaaggggatattattgctgaatcactgggaacccc

SEQ ID NO: 7410 - DNA, 2185 bp, Homo sapiens
tatgtatatttatgttgaacaacaacaacaaaaaaattaaagaaaaaaaaaaaggccgggcacagtggttcatgcctgtcatcccagcactttgggagacaaaggtgggtagattgccttaagctcagcctgggcttgagaccagcctaggcaacatgatgaaacccggtctctaccagaaatacaaaaacaaacaaacaaaaccacaaagccaggcatggtggcatgtgtctggtcctagctactcaggaggcagaggtggaaggatcgcttgagcctggaagggcagaggttacagtgagctgagatcgctccactgtactctagcctgggtgacagtgtgagactctgtcccaaaaagaaaaaagaaaatattttggttcaatacattgtaattagtgtctaataattaaatcattcttctcttgcagattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatg

SEQ ID NO: 7411 - DNA, 1181 bp, Homo sapiens
tttaagcaacaaaatagaagaatatcaatacatatccttgatacttattgaaatatttgtaaagatcagtaagctgagaataatgggcaattgtgttgaagcactaaacatagttgaaaagtagaatttaaatatgtattagcaagactagaatctgagtccctactagattctgacttattccatatacttctattagcctcagatattttttattatatagtagtaaatgtaatgacttacagtagtatcattttcacttacaaagcacttaggaaattaaaggaattaactcttgttatcaggtaagagagaccaggatatccacttgtctcatgactaaagtttgccttgtaatttggattaagggaaagtcattggttatatgaagtagacaactgtggttaatactgctcttatttacagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaag

SEQ ID NO: 7412 - DNA, 1280 bp, Homo sapiens
ccacatcacaagagctaccccctccttagggagtaaaaagggacatgttccggggaaccctctgtgaatacaaagaagtgctttcttccttatccccgaccttccctctcctcaactccctcatctccttcattaggcagagggagcattatattttggcatggcagtttaggtaaacaagggaaggactgatttcctgttggatccagcaaacatcccccaaacagtaacaacattatgctcacacatgcagctaatggtctgtgaaagaatgtgcagctagcaggggagcatgtggtgactgatgactagattcaagcagggaggttacccacagctgcttgctggatccagtttctaagagggaccaaaaaaacaggccaggcagccagccaccggctctggtctcagccttgctgcccacattacacgtttgataggtgcagccagttctaattcttggaaaaggccatacaagggttgtgctgttacaactctgagctgaaagggaaggacatgggaagactggtggctggcatgacttataactagatgaggaatgttaacagaataccaaccaccaaattccaggtagaaccaaaaatgtcaaaagactttcatctcagcatactttagcctcagagaaactaaggtgctaagaatgtcagcttagtcttcagaagcctaacttacctttatactacaaagactttcactctatgaagagcatatcataactaatgggaaatgtacttttctactaaattccaggtaatcctgagatttagatgttcaacacatatgcacagcagagtacattagctgtcttcctgaatatctaacaaaggcaccagtggcagctacagggtgctctccagctaactcagcttgagaaagcatggcttggatgtgcccaaggatttaattcccatctggaaaagctcaatatagtctgtgctgggccatagcaggagctcttacctccagctagcatacatcaatcccaactacttgaataatgtaactaaaaagcacattctctactaatggtagaagcagcaacactccataattttcaagtgtaggcttaaaaaaaaatcctttctctgggtctggttataaggataaatctggaaagttagaggtggctgactattggctgaaaaaaaggacaggctactagcatacagcattagaatgagaaccaaaataagttattgaaattacgaagattacaagaaaactgggaaataaacatggggctatatgttaccattaac

SEQ ID NO: 7413 - DNA, 1159 bp, Homo sapiens
tcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagaagccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctggaatgtggctgttttccttgcccctggaatcttctgacgtggcttcatttgagatgc

SEQ ID NO: 7414 - DNA, 1380 bp, Homo sapiens
attgctgagcctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagacatggagttgattttatgaccactaatgggttgtgacccacagtttaaaatgaatgctttagagggttttactagtggctaaaggaaaaactacaatgtgttcttacagtatagcttccttcagtgaactcaccatataactccctggtgattttgcgggcttgtcatttggaggccagctgtcttatgttacttaagaaactggacttcttggactgtgagaggagatgacatcactcaggttgattatagaacatcagcccgttccctgctgtcagagtccctcctggtttattgaaacagaaccacaaaaacatacatcacaatttccagagtccaagggccgctccaaatggccattttgtagaatttggtggggtttgatgttacttaacacaagaggtctattaattggagtttttaagtatttaaagttaattcttgtgattttaataggatctgccactttctaggactcatttgggttgttagaaa

SEQ ID NO: 7415 - DNA, 1185 bp, Homo sapiens
caaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgttgggaattgttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggag

SEQ ID NO: 7416 - DNA, 1189 bp, Homo sapiens
ttcatggacctgactgcttagcactgatttctctttttgcctgacttaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggtactaatcagaatatattttgttgtcagtctcttttaaggcatgaaagaggagacaaaagaagcagaaagcaagctacccctttcttcttgagagtctgggtaatgggagggatatctctttcattgtcaccccctacctctcaaataaataaatgtttaggaccttgaggagaactttatagggtatcagtttcctgagtcttatgtgagccgctttttaaagaaagttttgtctgtttgtttgttttaacttaaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggtgagatgcagggtacaggaaacacaggaaaacggtggcacaagagatgaaaggccagtttcatgcactgtcctctgtggttccctggtctatacccctaaacccaattatgacacaatcattcattcccaacttcttgtcatttgctgctttgggatcagtatctatctgggatgactatagtgattcttagtttggattgagggttgggagtagtggtgatggtaatagatttggatcatcgggcacatagagaacataattacagaataaattaggaagagggtcacctgatgacctggatacttagggactagtcagagagctctggtaggaacactaccttttctgtaactctgcctagaaccctggcaataactgggggagtccctcttcttgctgctactgcaaagctcagtctccattgccttaggcctgttttctcagccccagccagtcacatcatttccacttgacctttgcaattcagcctgacaccttgccacctgatccctcttcctgcat

SEQ ID NO: 7417 - DNA, 1874 bp, Homo sapiens
aacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaattgtcagtatttccttatagcaatgcaagccgactaacacaggtgattcttagcaaaacagtttgtcaatttttcataaatgctggaccctggctgggcttatgctattgcctagaagagattcccaacttctctcttatttgaatcttagaaaaatcccaaagcccaagcctcatctaagaccaattaagtcacaatccctggaggaagtaaaaggcatatttttaaagttccccaggtgattccaatgtgcagacaagtctagggaccactggcttaggtcctaatagcctagttaccttagaaagttctgactagcttattcccattcccttctaatttccaccccaccttatcatttgatctgctatgttgctcctattagtatgttagtaggatatggtctcttctggatagaatccttcaaagaaagggaactgtagttcctgaggcaggttcccacaccatcctctcctgatcctcaaacccaggttgtccttagttagtaactgagtcagcagagggcagtatgacccaacccaaagaaccatatattaatgcttctacagttgcctccaaggaagtagcaactcatgagtaagttaaggtttcagatgttttacttcatttttcttttattacagatgatgagtacatttggaaaaacaactggttgcatttagctatataactgtattatatctatgagcttctggtgaatgattatcttagggttttttttgtatttatgttattcccagcactcccagacacatatcaaatattgaattagtgaatgcatgaatggaaaatggataattacagattgatgttccaaatacctttttccaaaaaaacaagtcatcacatacctataggattaaatagatttcccttaatattttcaaaggtctctctgcacttacgtccattgtttttaaaacatgaaggaaattaaaacacatggctttctt

SEQ ID NO: 7418 - DNA, 1115 bp, Homo sapiens
aagatctcaatacatagtgtatattgctaagtgaaaaaaagcaagtgacagaacaatatgttttttaaaagcacaaaactatatatttatttctctataaacatactaaagtacaagtatgcagaaactggtaacagtgactactctggggaactgggatggattgaagaataaggggaattttaggtttatcaattttgttcgaatttctttcattgtaagcatatttgcttgtgaaattaaaaatgtgtgtattttaagtgctctgataggaggatgtggaggtttgtgtgtggttatccacgcctggccattttcaatgtgaactttgggttactgcctttcctattgccttctttcctttgtgacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttt

SEQ ID NO: 7419 - DNA, 1169 bp, Homo sapiens
gggactacaggcatgagccacagtgcacagctaatttttaaatttattgtagagacaaggtcttgacatgttgcccaggctggttttgaactcctggtctcaagcgatcctcctgccttggcctcccaaagtgctcggatttctggtgtaagccacagcacctagctggccagcagttttaatcaccattgctttttcacagagattacaaaagtcagcagagtaaaatatgtagataaagtcttagtgttattatgagaatggttttgacctcacagattctctgctaggatcttggagacccacctgtagggttccatggaacactctgaaaactacaggtttatagaactgctccaattcaataaattgtcaaaattgttcatgctcctaaagctctaggtgtatttccttgaatttggtagctgtttaaaatgagaggttgcactattagtcgtgataatgttctgctgggtgatgactgaggtcaccatctctgctcctcttttctttaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaa

SEQ ID NO: 7420 - DNA, 1277 bp, Homo sapiens
cattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgagatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtat

SEQ ID NO: 7421 - DNA, 1118 bp, Homo sapiens
tcaagggatctgcccgccttggcttcccaaagtgctgggattacaggcgtgagccatcacacctggctcttgtgtgtattcttaaacctggattgttggtccagaatatgaaatttattattcagaggtaggaaagactcagaggagatgggacttgatttagaacttgaaagaaataatttggattagcagagagaaaaagagtattccaggttgcagaaaagcaagcaaaaaagacagatacaggaataatctcaagctctgtgagtgtagcgattgtgtcatttttatttccccccttgtatgtggagcggggcttaagtattgcaggtgctctgtaaatgtatattgaactgaattaaatggaaacaagtggttcttttagcatcagtttctagcatctatgggaatcctgtttgtgtggacaggaaatcacaaagaatgataaatcaactctaaaatcctcaaaagtaactaacctcccttgccctttttctcatcttcttgtatatagtacaggacagcaaaatacagcttccaattatacagctgcgtaaagtgtgggctgaagcagtgcactatgtgtctggactaaaagaagactatagcaggctctttcagggacaaagggcagcaatgtaagtggattctgttgtttataagcacaatgcaatgtgcatcatatactcaagaattaatcttgccggttttcactaatcaatattgcatgtaatagtaacatactgggccaatttgaagtgtaatgttctgataaacttgtagaattcttactaatggactgagaccattctattgtaatggcttgagggtaataattcccatacggtcctagtataaaaagattgtttatcacaaaatattataggcaggaagtctttagagatcagattctagagctcagttatttctcatagattgataatagaaacttaggctttggccttgtggcagtttatgtttttacattattgttcaatgtttctgaatgctgataatatcttttttctttttcttttttttcttgctgtggtttaggttaagtcttcttagatataatgctaacttaacaaaaatgaagaacactttgatctcagcat

SEQ ID NO: 7422 - DNA, 4585 bp, Homo sapiens
agagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactgggtctgggagtttcttttggctgtgattcaaagtcttgggatttgtctctggctcatatctatgtctgtacctttaagagtataaaagaagtagaagttacaatggttgactcataccccattaacctgccctgctgtcctaaaggtaactttaggttaaactctgggacgcaggaagccaggagtctgctgccattaaatcaaacacattaacaccagctggcaacttggccctggggaagtgccagggttctcgggtgtgtcacgtggtcggtcacatagacctaagataaagacactgggagaggaaaagaccagcaggagaagcgctccctgggaaagcagttttttg

SEQ ID NO: 7423 - DNA, 1205 bp, Homo sapiens
acactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggtttcctctgtcatctcccagtcattgcctcctctgggttctattttgccattacctttctagtcctctttattcttgcttcctgcaccctagtaaggcaggggagaggcttagggagagataaatcaagaaagttaaaggaaggtgtccattcccactgaattaggttctctccttgcagcatttgtggtcactctgctgggtgtgttgagggtggggggattgtctcccttcatccgtgcctggtgttcagttccagggttttccctaccccacttcagggctgagctcagctatacaaagggactgggtgtgaagccaggggatgctagccctaatcctgttgtagatcccatcatgtctgcgggctagatgtgtgtgtgtttgggagggagggattgttaggcagtatttgtttgtaaagccacttgctcttcagataatacttgcactaacttctattgatgaagcagtgtgagccctagcaaagtcctttcc

SEQ ID NO: 7424 - DNA, 1057 bp, Homo sapiens
aaggttaagcatcacttctttaaagaaaaagtttgggggccagatgcagtgtctcacacctgtaatcccagcactttgggaggcagaagcaggaggattgcttgagcccaagagtttaagaccaacctggacaacatattgagaccttgtttctttaaacaaaacaaagaaaaaccagtaaattaaaaaatttggtgttgaacataactcaatgaaggataagtaagaattcagttgtatgagaatccatgttggctaaaatttgcctgactacatctgttctctgtgggagatgctggtatggatttgggcttggattttcagatgtggagaggccatgccaggggctgtgtgtgcatgcactaataggattttcttcttggggaacataggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggtaagaaatctttcaaaagcagcatggcttggagtcatatgaacctgatttctaatcctgtcttcaccgcttattagctccatgactttgaacaagccacttcactttcttaagcctcagcctactcagctctaaaagaaacataataggggctggatgccgtggctcacgcctgtaatcccagcagtttgggaggccaaggtgggtggatgatgaggtcaggagatggagaccatcccggccaacatcatgaaaccccgtctctactaaaatacaaagaaaacaaatcagctgggcatggtggtgcgtgcctgtagtcccagctactcgggaggctgagagaggggaattgcttgaacccaggcggtggaggttgcagtgagccaagatcacgccactgcactccagcctggcgacagagcaagactctgtctcaaaagaaagaaaaagaaacataatagggccaggcatggtagctcatatttgtaatcccagcactttgggaggccaaggcag

SEQ ID NO: 7425 - DNA, 1520 bp, Homo sapiens
atgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtgattgcagtgatctctatctctccacttcttttgggaaagaggagcacaggagcggaggaaaaacttggccacagtcacacttggaaagatagtagattattttcgttctcctcagcaggtctgctgtattcctcgctcagcgctcaaagatgtgggtgatgtgtcaaggaggcatgcactcagctggtccttgctgagttatttgctgac

SEQ ID NO: 7426 - DNA, 2136 bp, Homo sapiens
cttactcccctttgagaccttcagctgcttgtcttccactgcctgcatacttctctgatgtcttctcaaactgttggctctaaagggatgttccagcctccctctccagagctgcctgcagtttcccttattcagctgtctcctgcctagtctctccagcggcctccttaccaagaccctttttcctaaacagttgtccttccctcagaaactccatggctgcaagtgtgaatagacttgtctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttattatgtgatttattcagaaacttggtttcagtgatctctaaacagatttccagtggttctttctctctcaagaaaagcatagggaaaaacgagaaacaccttagataaaccatattgagttgagggtagacagaagagtctagtacctaaactcaccctagaggaagagaaacaggaagtgtcttatgcctcttctgcctgggcagccagactttactgctgtactaccagcccagggccttgggtgagaaggtttcaggtctgagctccccttgcactgtgtgagaggccgtggagccgaatgagtccttattatacctggagaagctgttgtctcctcacaccatgaaatgtaatagcagtcaaatcaggcccctcttgattcaattttagtccatgcctttccatgtatttaaattatataagtgttggccaggtgtggtggctcacacctgtaatcccagcacttcgggaggctgaggcaggaggatcacttgagcccaggagttcgaaccaaccttgggcagcatagtgagaccccttctcttaataattttttttgaaaataattttttaaaaattacaaatatggaccagacacctgggaggattacctcacgcctgtaatcccagcactttgggaggctgaggtgggtggatcacctgaggtcaggagtttgagactatcctggcca

SEQ ID NO: 7427 - DNA, 1577 bp, Homo sapiens
gttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaa

SEQ ID NO: 7428 - DNA, 1158 bp, Homo sapiens
cattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccacagctatgactagtctgcttcatctagatgcgcccacccctgatcaccaggggacaggctcctgagcctatacagaaggtgatatctgcctccaggattggctctgctccccaatacaactatttgcagaggaaattgggatcctccgcttccatcctgactccttggcaggcacacaggcctctttagtaaggttcacactattcattgatcatggtgttagggcatgacaagaaaatgacaacagttcaagaattcttacaggggtttctagattttcatttcctgcctctcatttccccaccatcccccctttttaaactaagattagaaaatactcattaatatcagccttcctgcccttccccaaggttctcagcaccccccaccagctggctcaagggacatggattttatttc

SEQ ID NO: 7429 - DNA, 1191 bp, Homo sapiens
ggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacaggtaaccctttgagaaatcactacttagagtaaaggggcagaagatcaggtgacaaaagcaagtgggtttgggccatgacaatgttgaaaagaaggttggccctttccccccagttttaaagccctgacctatgtcttggtttcaagggtaggacttcctcctcacccaggtctgttccaccccactgcagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaact

SEQ ID NO: 7430 - DNA, 1150 bp, Homo sapiens
ttttcagcctgggaggaggtgggatggcaatccctgggcctgagtggggttggattcaggggacgttaactggcctgtgctgttctattgcagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccg

SEQ ID NO: 7431 - DNA, 1237 bp, Homo sapiens
gatggcaaccacctgctggccacaggttcctcctactacggtgttgtacggctgtgggaccggcgtcaaagggcctgcctgcacgtaagtgtcctgcccacctcttctccagcatgccaggactcatgattatgggctgcatttgggagagggtgaggtagccaaggacgtgcctagaaagggttggaagaagcctacaatggcacacgtccctcttcccctgggcctggggatcctgggttagggcacacccatgtcccacttggaaagctcttaccacttcctgtgccctcccttccaggccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacagatctggttcctcactggctgagtagtcctagcaggctccaggagaagggaacagcagacccaagctcagggttgtatgtgctgctgaaacgacaagaccagcctcatggctctgtgtcccaaagaacaaaggtttctttttttcaggaagagttcccattgatgacctatcccttaccctttggggtatg

SEQ ID NO: 7432 - DNA, 1154 bp, Homo sapiens
tgtattcattttggtgagcagatgttttggatttgatgaagtctgatttactggatttttattttctgttattgctttctgtgtcctaagaaatctatgtctaccttcttagtctgagagatgtttttatatattttcttctgacagctttatagttttagattttaagtttatgatctgttttgaattacttttcctgtatggtgtgaggtaggggtcaggattcatttcatttttttttttttttttttttttttcccaatctggacatccagtggttccaggattgtcatgcattctccattagattgctttggcatcactgtgaacatttttgatagtttaaaggacaggcttttctccttggctttcttagtcaagtatggagagagaacagttactccttcctggtctcctaatctctttacttgtattctggatgctcctgaatcctgactcagtaagcccatgaaattttctgtggttggcaataagttgtagtgattggattatctgttctgtctggacataggatgaccagtgtcccagtgaaggaacgagtgaaggtgtctcagaactggagactggggcgctgccgagaggggattctgctgaagtggagatgcaggcaagtagcctcttgactttttaaaagctacttgggacataaaagcataatggaaagtaaaaaatctggtcctacatagaggctaatggggctatcttgggtgggtgggcactggtgagcctttgaataacacaaagggggcatcagaaggacaactttttcacattttaaagaagggaatacaagaaatgtactttaacaaatgactttttttatgattataaagaaatcaatgcttattttagaaatttgaagaaaaagaaaattctaaagaagaaaataaaactaacctgtaactccaccactcagaggtaacctctgttaacatatgccatcaaaggaaataaatcaaggtttcaattcatcttattttacaaatatttttatttaaatcttctactctatggagttacttcttcattcttggcttccctgagtcctctcccctactttattaaaaggcagggtaggatctaaaggtttggatatatatgttacaggagttagagcttagagcaagtataag

SEQ ID NO: 7433 - DNA, 1214 bp, Homo sapiens
ccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaac

SEQ ID NO: 7434 - DNA, 1225 bp, Homo sapiens
cttcctcaaaatgtaaaatgtgacttcagacaggttgaattccttcatgggctgtgataataaagtgtctaattatcagtcattttagttaatagttactataattttatgacagagcaagcagctagcttgatttgtataatatctagggaatatataaagttgactcagacaaacttgggacttactttccttccagtaattaaagagtagaactgataatactgattattcattaattggaggaaggaacattagtattgaaatgccgttaacattttaaaaaataataattattatcatagccttgccctgaaaccctgattattgttagagagttatttccacgaagtgtttgtcagtttgttggacatttgagaccccaggaaatcccctttctcgtaacgttctccgcttggatctgatctcaacagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgttttt

SEQ ID NO: 7435 - DNA, 1489 bp, Homo sapiens
aggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcc

SEQ ID NO: 7436 - DNA, 1204 bp, Homo sapiens
gattcatgaaactacttttatatagaattgaaaaataccttggagtttgatctgcaatagtgttttacctacatatatatatatatatatatattatatatatatatatgtacacacaattaaatttgaaagtagtatattactctattcagttattttaaatcggatttttttggcctcttagctgctattttctgccttgggtctctttccagaggaatttctaaagacagtcaagtgcagtgtgatttatgaggcagtaaaggccaagtactttgcagtgacgaggacctacttactttggggaaatcaatgaagcacatcagtctgcagcacacttcctgccttaatggtcctaagctcgatcaatatttgaaatttaacttcaccatcagtctgtgggcagtgtgtgctttgctgccttccttccatcaacctcaaatatatggccagacctattacagatggagcgagttacacttttgtgtttggttttggatctgctttaagccttgtccactggcacattttaagaatgtaaaatgtgttgtgctgttggccaagtaatgatttaaaccttgacattacctagtcagggaggggagtgttggacagatgcacaagctctgtagcatggttgtttatcagttcttcttcctaaacgttgtctcattaagtggtacgtcagtgactccagcaccttggagagcattctggcactgactggctttcttttcttttctaagatttaatttttttagagctgtttttaggttcacagcaaaattgaaaggagagggcagagatagcccatacgtctgcttccttcacacatgcattgcctcctctattgacaacatcccccactagagtggcatttgttataaatgatgaacttacattcatatattgttaccacccaaagtccacagtttacattaggattcactcttggtgttgtatattctatgggcttggacaaatgtatgacatatatctgccattatagtatcatactgagtattttcactattctaaaatgtgactttctgttcacagattctctaaccatggcacaggtagagaaacgtggaggtttgctccggaaatcttcagcctccaaaaaaccactgaaggaaaaagtggtgctgatgtatgatgagatcttcatggtaaggcctgcggccttgttgtgtacagcttg

SEQ ID NO: 7437 - DNA, 2260 bp, Homo sapiens
tgcctaggctggtccctgcagcctcgacctcctgtgctcaatcaatcttcttgccttggactcccaaagtgctagattacagatgtgagccaccgcgcccagctatgactcctttctttctcgtctaggttgttcctcaaagtcattcaagctgtactcgccgaaggagcccccgaacggcaacgcctttccccccttccatcccggcaccatgctggatagggatgtggggtaagtgagtctcttggccacttcctaacccttctccaggtgggatcctgcctggaaaggggagggagtagccccctgcccccaataattcctatcttcaacccccattctcatagcctcttcctttacacagcccaactcccatgtatccgcctacatacctggagccagggattgggtaagtggagtccagtggggaagaaggtgctttccactgggtgaaggccgaggtagggggtggagggggcaggctccgctcctactgacctctctccttcacttcctccaggaggcacacaccatatggcaaccaaactgactacagaatatttgagcttaacaaacggcttcagaactggacagaggtatggccaagggaaaaggggctgggagcaggagggccatctgggcaccctatgggatatcttatgacacatgaacacccgttaccatgctccctaggagtgtgacaatctctggtgggatgcattcacgactgagttctttgaggatgatgccatgttgaccatcactttctgcctggaggatggaccaaagagatatagtaagtggcctctggggtcttgctatgagggtgtatacctcctatgtcgttctaaggtctagaagtgggtctgggagtgccaggggatatctagattggtaggggaggcatctgcctggccccttttgcggtccctttgtcctgaagagtttgtcccatctctacagccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactggcaaaataagaagggcgggtaggcatgttgcaaccgtcagcaaacatgtattgtgtttgtatgggatagttttctgggccccaaggctacacgagtgaacaagagtctgccctcatatagcttagagcaggtgggtgtatcactagccacatggggagaggacaaggatctgttaagcttttctactgtgtgtctgtgtgtgtaagggccaggtatatgggtggggggtactgtgacatttatgcacccagatttaatgtgcaggtgacaaaagtgtatgcaatgggagagttgtaagcaaatgggagactgtaatagacataccttcaggtatggtatgtggggagggggcagggttctgacaagcctgtccccaggtgtgtgtggagggccggttgtacctggagttcatgtttgacgacatgatgcggataaagacgtggcacttcagcatccggcagcaccgagagctcatcccccgcagcatccttgccatgcatgtgagtcgtgggcaggacccaggatgcaagagtgaaggcaggcgggggaagggtggaacaaggtctgccatttcccgactgactacttagacagagggttagggtttcttcatctgaacagcaggtttaataagagactatcctctctcaggagtgtcacaatgctcagatgatagggcaggtgagcagaggcaacccaggtgtcagtgttctttcttgtcttttctcccactctaggcccaagacccccagatgttggatcagctctccaaaaacatcactcggtgtgggctgtccaattccactctcaactacctccgagtgagtctccgaccacccagtttctgccccagtccatttagtctcggctccatgtctgtcccctgacaagccacctccttgtctacccctagctctgtgtgatactcgagcccatgcaagagctcatgtcacgccacaagacctacagcctcagcccccgcgactgcctcaagacctgccttttccagaagtggc

SEQ ID NO: 7438 - DNA, 1165 bp, Homo sapiens
caagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgac

SEQ ID NO: 7439 - DNA, 1239 bp, Homo sapiens
ctggctactaggtttgggtagtgagaggatgagggcttcaggaagaccctagctggctggatttctcttgctggtccccaagttggggaacatggggaaggggcagttgaagcagtgggaaaagttgggctgcttaccttgcttggtgtactttgtgagatgaggtgggggtctctggaggctatatacacggtatttggaagcgtagaatcggatctcatcctgctatctccatcctccctccccaccacagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtgagctttgatggccctgtaggtcctctccatttaggaagttcacgtacttctgtggtttactttgaaagcttttacccgttgactttggtactttcaggcgctaaggcttctatttctgactttggcttttgtgttttcccttttcctggattgttgaaggaggcaagctgtgagacaattgcttctgtcccctgttggagcttggggtgtcaggtctcctgcttctttgagacctgccttggggagacttttagggtttgat

SEQ ID NO: 7440 - DNA, 1228 bp, Homo sapiens
ggggctaggcagacttaccttagtttgacatacaaagaacccaagggggctgggcatggtggctcacgcctgtaatcccagcactttgggaggctgaggcaggcaaatcacgaggtcaggagttcgagaccagcctggccaacatgatgaaaccccatctctaccaaaaatagaaaaaattagctagaggtggtggcacgcacctgtaatcccagctactcgggaagctgaggcaggagaattgcttgaacccaggaggcggaggttgcagtgagctgacatcacaacactgcactccagcctgggctacagaacgagactgtctcaaaaaaaaaaaaaaaaaagacccaaggggtgggacgagaggagaaatggggactggggactctcctatctctttgacttaaaattagagcagttttcactccatccgtttttgggatgggagatagctagccatttgcagaccctgtggttgggaagtgtggtcagagaccttgaagtttgtctttacctttatagactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaactcccaactgctgttgtgcgtctttatatggtgctaatgccaaatgtattcacttttcctatctgaacatggtccagggacatgcctctccctggtcaggtgcaaaaatcccactggatttgaaccttggttcctcagatgtattgtctaaaatgagtcatttaggacagtgcttctcaactttaaagggaatttgaatcatctagcgatctttttagaatgtagattctgacaatgggatgatgatactggtccaggaagggattttgataacaaggacctagagaagctcacacttgttccaa

SEQ ID NO: 7441 - DNA, 1204 bp, Homo sapiens
ctgtagggagaaaaaagggcatcatccccattccgaagggtcagggaggaggaaattgaggtggattcacgagttgcggacaactcctttgatgccaaggtgagagagagatctgtgccattcttgggagggaggatgggtagtgtcagagaggacaattcttggttcaggttggtgggaatcttctctgggttcaggtttccttgagcagggagtagaaagaataaagtgacagggctccagcatggtcctcctctgtgttaatctccctctctacttaccagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaactt

SEQ ID NO: 7442 - DNA, 1157 bp, Homo sapiens
agctggcagagcgtctggggctgcgcagcctggtagacacgtaccgacagacaacctcacccagtggcagcctcctgcgcagctacgaggtgggttggcctgtgccctgccccctccccagcctcctttcccgatctgagtccaggtgcctccttggccccagggctcccgagcacatgccctaaccatgactcagacctcattcctctgtcttctcagctggctggcggggacctggcaggtctactggaggccctgtctgacatgggcctagaggagggagtgaggctgctgaggggtccagaaacccgagacaagctgcccagcacaggtaaaggggcctccctggaaggtggatctggacctggagggccggaggcctgaggctttgactatcccattcctgtccccatttacccccagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttatggcagcccctgatgtgactcttgtccctggaaccagctacccaccctgcccacatgccaggcatggtgagaagagaaggaggaggcccagccagcaagtccagagcagttttaatgggggtggaggctgtacaaagggcaaggcccactgaagcgggggaaagccaggccgtgctgcccccggcccaggtatggggccttggcatggacgcccttcctccacctccagcaagagaaagagtaagcccttggggaggaaggaggggaaaccagctcagccccaaatcctggtctctgtccaagccaggccccaggacagagggggactgatggtgtcagggtgggggtggtctcagcagaaagcagaaacggcatcaggcctctcccacacaaaaaaaaagcatcaaaagttcaggggcgctagcccctcccgcccccgcccaccctgtacgaaaaagtgc

SEQ ID NO: 7443 - DNA, 1396 bp, Homo sapiens
tggagctgttgcccaaaaaaatggatctgttgcagtggtgcaatctgggctcactgaaaccaccacccaggttcaagcaattatcctgcctcagcctcccgagtaggtgggattataggagcgtgccaccatgcccggctactttttgtatttttagtagagacagggtttcatcatgttggccaggctagtctcaaacccctgaccttaggtgatcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcaccctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggacagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcagctgtgcttgaagtggcatgcctcctctgctgcagggctcccccacccccacacggcctctaaagatgtttatttccttatagactgattaaagtcagccattctttttcctcaagtctgtgctgtgtgagtgagtggtgggttgctggggttgagaaccaggattccttactgactagaaaaagcccctgagagcatttttctgaataagagtggtaggtaggccgggcgcagtggctcatgcctgtaatcccagcactttgggaagccgaggtgggtggatcacctgaggtctggagtttgagaccagcctgagccaacatggcaaaaccccatctctactaaaaatacaaaaattagccaggtgtagtggtgtgtgcctgtaatcccagctacttgggaggctggggcaggagaatcgcttgaacccaggaggaggaggttgcattgatcgcgccactgcatgcactccaacctgggcgacagaatgagactccatctcaaagaaaaaaaaaacccaccttggtgggttaccaagatgccagggagaaaaacata

SEQ ID NO: 7444 - DNA, 1087 bp, Homo sapiens
attacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagaca

SEQ ID NO: 7445 - DNA, 1458 bp, Homo sapiens
tgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaagtgcctgggttgtgtgctcatttctggctgcctgaagtagtggagccggaagcccggggccctggcagagggagtgggttgttgttagccacttagaagccaggatggagggaggcccccaggattgttgtcgagagtggaggaggtgccagagagtgggatcacacagctggtggctcttcagtcttgaagaaatgaccttgcaaggacaggctctccctcactggtcctgaattcctctaaggtcaagggggtgggagcgaggagcagtctggggagatgaggcggtgggaaaagaccctctccctgccactacatccctcttctatcctcctctcaccaaaaaccccttttgccttaggaagaggggcccagacaggtgaggagggcaggccctcctcatctcctttggagtccttgcccggcttccagctcctctcacatgacatctaaattccacctcctaatccagggcccaggggcaggatccag

SEQ ID NO: 7446 - DNA, 4282 bp, Homo sapiens
aatgcaaatattcagtgggagctttgcagtctgcctagaacaatgaccagtgcagtaatttctccttcctacctccccattttagggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgctactgctctttcttgctgcactttgttccctcttcttcttcctcagtcttcaggaaattgcacctcaagatcctaaaccacaagcacttttctccacacagagactgagaggttgtcacacagtcattgaggatagggccctgggccaaagagaaaccacagggccaagggcagctggacagtgctgctgggtccacactctgttctgaggagtcctcccctctctctgtcagggtgtgttcctgatgtttggaatactttggaaagtcccacaaacaggctaaaatcagatcccgagaaagcagagacaagttttgtcagataccctgttgctaaaacatggcttttttttgagacacagtctcactctgccgcccaggctggagtgcagtggcgcgatcttgtctcacgcagcctctgcctcccaggttcaagtgattctcctgcctcagcctcctgagtagctgggattacaggtgcctaccaccacgcccggctcatttttgtatttttagtagagacgagg

SEQ ID NO: 7447 - DNA, 1127 bp, Homo sapiens
ccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttcattggcttgctctttctctctccatcctcctccctacttgagtcctctaccctcagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttttttttttttggtcccgtgtgtgggcctctgttcttgaggggtctgccgccttcattgtctgggttctcagtgagtaggtgaaggtaggggctggctgatgccatgccatttggtggactttaatcacaggcatttggaaaacatgtaactagcttttgtaaacccagtgcagtcctttttctcctccttaaacatccacactggccttt

SEQ ID NO: 7448 - DNA, 1127 bp, Homo sapiens
cgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctc

SEQ ID NO: 7449 - DNA, 2367 bp, Homo sapiens
gggtcacagggaccccccgagggtgctgagtggcctgctactggcacgcaacctgcccccgtgggatgaagccccaccgcgtagcttgaccttagaggggaccccactctaagcatccttttttttaaacagagccatctagatacaaaagtcagtttcttaagatgcctctcactgagcacaacaccagtgtgatgagtgtataaagatgaggggtccttgcaacaaagcaaagcgtagcccatgctggaagagggcatctatccccctcttcgggtctgcgcagtgctggccttccctgagctgtggggagccaagcctgcctagcccagcttctctggcctcaggaactctgccctgtcaacctatctgggctcacgtctgcttctccacacacagtctctcggggatgccttgctactgggagagcctctggaatcagagctagtgtgttggtgcccttttcagagctctgctgttcctttataaatcctaaagaactgagtctggggagaggagaggggatgccagctgctgcctctgacttcagggagaagcagacttcttaatactgtcttacgtgctcggtgtgatggcttcttgcaaattattctcttataaaagagctcggcaggagtggcatcagtgaggctcccaaaggatgaaattttagccgccaagttcgtattcattttctgttattctttaccttctgttagtcacactattttataacattagggaatctaaaataattcctgtcaggtccctgaaggaatgaaggctaacatctcctttggggagagcttaggacccttcaaacaacactcatgtctgagcggccagattcctcctccaggccccattttccctcaggaaaccaacctctcagatggttggaggagaaacactgggctgttgcttctttggggcagcaggagaatgactttggcttggaaggcctctgccattcatctctacaaagccagtggggtccggcagagaaagaccgtggaatagctgcggtctcgatgtggctgctctttggcacctccgctggactgccctcccgcggcggtgaccttttcaagtgtggaagggagtgggtcgagtggaccagatgcagacccctgagttctggatactgatgggaggcctcaccctcctttacggggcctctctgggtgggacagagcctcacctgctcctgagcagccactggtgccccacggttcctctgaaactaaatccctagcatccagatagtcctgggacactctgcctgctctgtaaatgaggagggcttttctcctgctgtttggaggttccgtcccttcactgcttgtcccatatgcgtcaggcaaattcaaaatcatacatttaaactcttaggaaaacaaaatcttaagacttacacagatatcggggtgctaatcaactggcttaaatcttgattcttacataatttgaacttgaaaggttacattgaactctgttctttcctccctcctcacctcactccctgcagggagttcaatgccatgttgaagtggttggcatccccaagtgggagggagtggggcatcttaccatcttctaatgtgacttcaaggaacagtgcaaatgttgaatgcagagcttcacactaatacggaacagtaactgtgagtatatttacctgtgctgtcgtcagcactgtacactaaaggaccagcttttccaagcctaggaaaataatggtagatacaaatagaaatacattttccctaggaaatagagcaataggaatttgagctaagcaggtaccatgaacttctgccctcaaattctctctttgggttgaggagcagacctgtataggccctggctgatcaagtctgtgtcctgcctagtaaaaacacacaaccacctctgtcatctgaaggccagccggggatctgtagccatcctcgccttgcctaggcccaggaaggtgaggtctcctgggcaaccagagttgcccctgtggttccccaggggtgatcctaggcagatgactcacccgggctggcacaggaaggtgctcaccttgttctctggggctccaagcaagagcaggccagggagggctggctttgcacgctatgtagcatgacccaagctccctggtggcatgggaaaaactcccctctgcttttgagcccagatatgggcttttctttgcaaagggttgaggagaaatacaagactgagctggtaggttagggtccagaaggcctctgaggtgccattgcttacttccttactgaggaaactggctcttgtcctgggccatgtagttccattctgggctctaggctagtggtgcttctgtccatcaagggtatc

SEQ ID NO: 7450 - DNA, 1203 bp, Homo sapiens
gcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgat

SEQ ID NO: 7451 - DNA, 1176 bp, Homo sapiens
ctgcactccagcctgggcaacagagtgagactctgtctcaaaaaaaaaaaaaagcacattcacaaggagtgtttggtgaataagaaactatatggtccacttattttctttaaattaaagaatttcaccttagtgttagattattaaaaaaaagtaagccagctttgacttgatcatttgcattactggtttgaaagaactgcaaaatcgtctttttttctccccttttcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgag

SEQ ID NO: 7452 - DNA, 1201 bp, Homo sapiens
tgttgagatgctgagtactgtgtacattgagttcattatactcttttttatgcctttgaaattttcataataaaacttttaaaagtgggttttgagaaaccataacatttagtaaagcaagggttcttatattttcaaatgtctaccagtttcttttaaatgtctccattctaaagaaactgtctaccaatggtgggtatattatttttcacttaggatatttaagttcttttcttaaaatgtttgtgatacatttcattagagaattacatttgttcatttttagaataaattcagaaactgaattatagtcattttgaaatgagttacttcttatcctacagcttagttcaggattatttagactactacattgaaaatattctgggatggtttataagtatatgggggaaaggcagatcccttaatgattacattgaaaaatgactttttaaaatcactgaaacaggttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtatgggaatgaacctaagaactctataatgcagattatgaaaaattgtagcatttccatctacataagttacacatttttcttatagctagcttggaaacaatttttttcgtttgtttgttttgagacggagttttgctcttgtcacccaagctggagtgcagtggcgtgatctcagctcactgcaacctccacctcctgggttcaagtgattctcctgcctcagcttcccgagtagctgggattagaggcacacgccaccaacctggctaatttttgtatttactttagtagagacagggtttcaccatgttggccaggctggtctcgaactcctgacctcagatgatccacccgactccgcctcccaaagtgctggcataacaggcgtgagctactgcgcctggccgcttgga

SEQ ID NO: 7453 - DNA, 1388 bp, Homo sapiens
aagtactgcttgataatgctccttaggaaggaatagagttattggtcaagtttagatttttcacccaaaatgtacagtaaatacatagtgtagtggacaaaatgtccgaatgtaaatatgatggatgcaactaatggtttcctttgacttccccttaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacatttagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttgcattttgtacagtttttatatttttgatatcttgtaaataaagacaaccagcttttccaggttcataatttattgtacaaattgaattatcacatgatgagttggcattagcttctccaggcatgggaacttaacagatgaggttaagaaccgtagacagtttaaaatcctataaacaaagcaaacagtttagatacaaatgtggccagctttactcttaagacactcaagaattact

SEQ ID NO: 7454 - DNA, 1147 bp, Homo sapiens
attctcgtgcttcagccacccaagtagctgggactacaggcatgtgccggcatacccggctaatttttgtatttttagtagagatgggattttgccatgttggccaggctggtctcgaactccctggcttcaagtgatcagcctgccttggcctttcaaagtgctggaattacaggcctgagccactaagcctggccaccatgtgatatttcaatacatgcttacaatgtgtaacgatcaaaccagggtaattagcatctccatcacctcaaaaagaaaaataatttttaagacttggattgtacaaaaaaagttacttatgtcttccatttatcccaaaggctgccctgggggattgtgtagctctcagtgcatttcttcttttcactgcctcctgatctgatccaaaggctcggtagatctcccaagtcctctgcagcagtagtggagggcacgttgcagggcctgcaaggcttgctgggaggagttggccaagcctgtgtggtttcttgccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcaggtacgtggacttctctggacaagctattttatgttacagtggcagagagcagggaaccactaacacatggcatattggaacccacgaagcggaaagatagaggtagctagataagattttggggctagaggggttcatacgcattccttcctgtgtgtcagaacaaatggaagctgtccctgaaagtcctgttacagtgaggcttttcagcagtgggctgctgacctctttcctctcgggtccctagggccagcctgcagttctggctttcctggggctccgtggagggacttgagagaggagtgcgatgggtccacccatgagtcctggtgaatgtgcacgtacatgcatgctgggtggttggggtggtgggtggggtttggaagaaagctgcctcttagagatccttggtgccggagtttaatgcctccaagccctgcctaatccagaccaggttgttctctgttcatgacaagtgctatttttgtct

SEQ ID NO: 7455 - DNA, 1083 bp, Homo sapiens
tctcccagcacagcccgtccaagaaagccctttataacaaacacctccctgaagggaagctgctcacagccagggtcctacggtaggtgccttcccgttctctctctctctgtaatgtgaatcaaacccctttctccaggagccctgggaggagatttcagggtgaactgtaaacataatggcttgcgtagtggtgttcagatgaataaaaggcctttgtttggaaccttctcccccagtgcctgtgaaaacaggtggtaacttatctctgcatagctcctgttgttggggatggtggagggggcatcacatctaccccctgtatttttctactaagcatgaaaaattgtgcaaatcattcttgagaatattgaaaggactcccaaggcagatgggggcagggcccagaatcgtgggctgatcaggaggaaaaaggcctgggccgcctgtggtgccctctgctttttatgatgtctttacctccccatcttgctctgtcatagccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggtgaggtcctgcggagggctgtggctgcctatcctcctcctggagggacagccatgagggcgtggggacagggcacccagtggggccgagggagggtgtcgcctggggctgcaggaggatgctcctaggcattctcccacctggcctctcaggaaagagtgagcaagaagccaaagaaagccggcctgtcagaggaggacgacagccttgtggacgtgtactatcgggagggaaaagaggaggcagaagagacgaatgtgctgcccaaggtgagggtgacgtcgcggg

SEQ ID NO: 7456 - DNA, 1202 bp, Homo sapiens
acggccgcggcggcgatgtgcgtggctccctcccgcccgcgggtctgcgtggagcggggctcggcggagcgcggggcgttctgggcgctccgacgcagctggtgtcccccgaccgccgcggtcccgcccgcgccgggtccctcctgcgaccgccgcccccgccccccgccccggcagtctccaggattccctcgctccggttgttatggtgacagctgcgccggtgaatgagcgtcttagtgacacgcgcgcgcccgctaggccagatgtggccccggggcgcgccgcgttcccgtagccgcaagctctcggcggcgcgggtcggggtaagacatcaggcgagtatggtggcacccggggctggccttattcccagcacggaaacatggaacttgcacttgaaaacaaggggagcagggccgcgagaacgccgagctccccggatgcgggggcgggcgagccagcactaatgttcggtttccctagctccaggtaccgggcctggcgcagagtggagagcccagggaaacatgtaaatgagcgagcggatgcttggataaagtaattgagattagaaccccggcacttgaccctccgttctcagccaggctaggggcactagggcaagggttcagagcaggaaccccgggcagtctcactgatgcacagatgccactgagggcctttgaatgcccgcggaccagactcacaagcctggagctctggccaagctgagggaacagatctccgggacagatcatcagaagaccaccagctctgaactgagtggttctgttagctataacaaggtgggggagaggagcctctgcagcctatggcagtcaaagaaggcttcctggaggaagggggtttcagcaagggccctgctcatgtggctagtgccttcctgtagctcaacactgcaccaagaagccttcaggaagggaaacagaagtcattcttctccttcctggacccggggcatctctcctggtctatcagggatggaagatgttccaaggttccccccagggaatcagacttcctgctcctctaagtcatctctagctccctgctctggcttcagcaactcagatccagagtccagtgaagacatgggtgggcagggggacatctcatgtatccttttctgtaataaaggttcttcccccaagtctccatttggcagctcctcattatct

SEQ ID NO: 7457 - DNA, 1228 bp, Homo sapiens
cagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggc

SEQ ID NO: 7458 - DNA, 1487 bp, Homo sapiens
gagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtg

SEQ ID NO: 7459 - DNA, 1716 bp, Homo sapiens
ctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaa

SEQ ID NO: 7460 - DNA, 1248 bp, Homo sapiens
cacccagggatgggggatacccgggaaggaccagtccttcccttaggccgagaagagtactaagcagcagattctgggcggggcatgcccaggaatctgcatatgaacaattcccccaggggatttggaagctccagactgtgaagtccactgtcctccaagtggcttctctcaccattacaagaccgtctctgctggctcctggcctgtagcttctgaggagtttctcaggctcctggactttggtttccttttcacaaaaagcacagagagaccaagttctatgaatggatgaagagctgcaggctgagatgtttgtactgactcccattctaatcacggataaccttaaattgagcgcactccctgatctgatctcctccagtcctcacgtcaccttatatggaagaggaggcttacaccattttggagtgtgtttaaggcaatcaattacattatgtaatttagaggaaaacttctcaggtgtatcataacctgttattttgatgatgtcttaagtgtgtatagagatttatagccatggagtgcttttttatttgttatcatatgcacatctctataccgaggtgtgtactataatctcccccaatgggtgaagaaattggggttcagacaggttaaagaactgcccgtaaaagtggcagagctgaggaataaactcgggcctcctggtccatgtctggctctgccctgcaccagataagcgatgctgtctcttggctctccagaacccctaccgttccccagaagagctcccttcacagtgggcttccccccgggctcagactggccctggacctgcacaggtcaggaccacagtgatcagtcagaccttggcaagaagcagggcctgcaccttgctaacccctggcacactgccagcccacagccagtgcctgcttgctgacttgaaaacggatgtaggggcacctccctcagagagcggctcctctctgaaaggcgtttctcctgcattcctccatcctcaaaagcagcgaaagatgtgagtccctatgaccgcctgtcctcagagtcctatgctatagctagagataattagtttagctacaaggaagaacttctaaattccacagtttgggcaagactggaactagtcagtgagggtgtagggactctcggcccctggcctccccgcacagggtcatagcattgctccttcattcctggcccaggagttcacatggggtgacttgcattccttgcttg

SEQ ID NO: 7461 - DNA, 1195 bp, Homo sapiens
tattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgatt

SEQ ID NO: 7462 - DNA, 1166 bp, Homo sapiens
tgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgc

SEQ ID NO: 7463 - DNA, 1800 bp, Homo sapiens
gaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccatattcttccctgtctcttcaaatgtgttttgcatattcatcatttagtgaaacaaccatctatttcttcttctttttttttttgagacagagttttgctcttgttgcccaggctggagtgcaatggcacgatcttggctcaccgcaacttccgcctctgaggtttaagtgattctactgcctcagcctcccgagtagctgggattacaggcatgagccaccaccctggctaattttgtatttttagtagagacggggtttctccatgttggttaggctggtcttgaactcctgacttcaggtgatctgcccgcctcagcctcccaaagtgctgggattacaggcatgagccaccacacccggctaaaccatctacttcttataaaactacatttccttatctcccacccacatgaaggtatcatggcatataaggttcttcgcatttgtttgcctttctagcttcatctgtgaaatgggttaaatttagattggttattctatttatgaacccacctccacaggttgggtttctgctgccaaattatacagttgtacctatcattttggccatatatggagataggacccaaactgggccagtctctgaaaatttggaatttagctcaggaaaagaaagcccatctctttttgtgactgcagctgttgtatatatacctggaagcagcagagctgacatgcttaagggcagtgagtgtgcttaccgagaaaggcagaggtgataggagagaattttatggatcagtggcttcctggttttagttgctagtcattcttaagagctttctggatttctgcttttgggtccttttaagtgttaaaacagctttacttagctttttcaaaagcacttccctactagtttagcactcctctgaacccccctcaagtacatcccactttcagtccagtccctccacataatctaaccagtgttgaatggttggcacagcaggagacgccagggccctgcttttgtgtccattctaattgttagtgccatgccagtaaactcttaccctgcccacatacacaaattcctgtgccgctggcctttatgaatctgaggagactggcccagacatcatatgagctgcctctagcactgggattcctagatgggcacccctg

SEQ ID NO: 7464 - DNA, 1538 bp, Homo sapiens
cagtctttaaccaccgcaggttttgggttcatctaggcagctacactcaaaagacacccatgggcttggctgatcctagttttttattcagctttttcagtggatataggatatgtagcccagtgtgttggcaggacagcttcgagtgtctctctcagcaggagttctcacagagtccggggctattcccccacttaccacctcccaggatggctcaggtttaagggaatgaagccacacaggtgggagcaggagctactggcttagagactgctgtctataatagtaaactgttctgggagccttttcaccagaagccatgaagtctggtcctatgtatttccggggaaacagaacacaaggaaaatacttacctgtgagtaaggagaaagggtgttgcacaccttttctctcagcttgtgatcttagcacatgggggcctttgctgttgacctgtgtagccagttgttaaagatgtagtggtgaataccgtgtctgtccttctcttccctgcagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgctttgtcttagctgtctctttcttcatggtgctgtcccccggcatgtcgggtgagctgatctccagggctgctggctctgtggcagacatttcctaggtggaagggcccctttgagaagagacccctggcctccccgcacatttgggggcttagttgtaagctttttcttttctctagaaaacctaatattatggtgtttttatctcagttttttttcctgattttaaaatatgtcattcctatgcaaaaaacaataaaaattatgtcaaaagtcagttttccataactcaccctatagcagatgccacaagtgtcttacctacatggccacagctctcattgttccgttacttgtaggcaggattctgtgacaagtgcctgcgactcccattctgcaggatttcttttgacttgtatatgtggggcaagctccaagggttggagagttaatgtccctgagatctcagaccatca

SEQ ID NO: 7465 - DNA, 1137 bp, Homo sapiens
gacattttattttgctgaagcctcctggattggatgaagcgtttccgctcactctgtagcaggaagggacagggtctgcatgggagagattggtgatgctacctcagaggaggacccaaacaggaagtttggaaacaagtcagtatctacagaaacttaagttagggaattgttggtgcttaacacagaaattcagccttacttttcagaaaaataacagatgcctaaatgtcagtggcaaggaggggagaaggctattattggtttgatttttgagtaagatctcagtgaagaaagagcagtttttatctgtttctcctgatgtgctttggttctcctaatgaggaaatagaggctaaagggaacagctctctctgcccttaattaattcaatcttctgcagtgtgtgctaatctgttgttttcagctagactgttggcttcttgagggcgggggccaaggattccccagtcttcatagtccccgctgagcctagcacaaggctaagcaggcagaacagtctgctcatgactgatcgaggcccactttgttgtcatctttgttttccagagtgagtatattgctccatgtgactgtcggcgggcttttgtctctggattcgatggctctgcgggtgagtcactactttttctctgttcttgctgcacctttgttcgcctcctaaaaataactgaaccgagtttcagcctgtgatatagaagcaaaaagaaaatgcaaaccagatgctccacattgactctctgcagaaaggtgtgggttcccagtctttccctgctccccaaggtcacctttcagtaaccctttttattcctctctgtatctttgcttcaaagttttaacaatttttatttttaaaaagtttttgaactttttattgaatataacatacatataaaagttctatcaattaaactgaatatacctgtgttactagcaccccaaataagaaatgagactttaatatagtttcagaacctcctctcttagcttattggtcccagataattctcccaagtgcttggcttttggtttctgttttcactcttggcttaaataacaaaggttaactctaagctgcattggtgttcctcaaaaccattatgcctttgagtttta

SEQ ID NO: 7466 - DNA, 2333 bp, Homo sapiens
gtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatatacggacttgtatcatgaggtttccattcacaggtggttacttagcctattcatggtctgttgagttttatacttcagtgaaacttggtaagttattgatgcttctgaataaagaatgtcctgataaatatattttcaaattagttgaaaattatatatatatacaaaacctgtcttttttcagcttatgttagaggagatattccctgagagacctgttttgtctcttgataatgggtatggcagcctctatcaatgtagaatagatgttgcaggatatgt

SEQ ID NO: 7467 - DNA, 1259 bp, Homo sapiens
cttattttgcagatgagcaaactgaggcacataagttacatgagaaagtaggagatagaggactggaacatgatacttcgaataaagaatgtctcagcccctgggcaaccgcagggagtcgctgagaaacaagtttccccgggagtagactcccagctcgctcaaatccttcccattccacatcgtgtctggagggaggaaaaaaaaattcttccctcccagaagcaaagtcccgcaacttcttagtcttccctagagacaggaaaggaaacccagcgggactacaccttccgacgacctttgcgaatcttgcggaacgcaggcgccctgaaacggcgtgtgcactacgattcccggcagccgcgggcgggtgcgggactacatttcccagggggcagaggcaggggcgggagggggcgggccccggcgctgctcccgcccctcccccgtgctcgcggggagaggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgaggtaatggctgggcgccgctgcgtgagcccgagcgctactaatctttttcggcagtgcggtgcggccggtaagggagggcacgcgtgtgaggtgcgcgcatgaggtgaggtgtgcgcgcatgtgaggggaggggtgtgcgcgcgtgagggtagaggagcgcgcgtgtgtggggaggggcgtgtggggaggggagcgcgcgtgaggggaggggcgtgtgagggaggggtgcgcacgcgtgaggggagcgcgcgtgtgaggggaggggcgtgtgagggaggggtgcgcgcgtgtgaggggaggggcgtgtgagggaggggacgcgcgtgtgaggaggggcgtgtgggtaggggagcaggcgtgtaaggggggcgtgtgaggagcgcgcgcgtgaggggaggggcgagtgaaggaggggagcgcgcttgtgatgggaggggcatgtggggaagggagcgcgcgtgtgggaggggcgcacgcgtgaggggaggggcgtatgagggaaggg

SEQ ID NO: 7468 - DNA, 1470 bp, Homo sapiens
ttattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgt

SEQ ID NO: 7469 - DNA, 1230 bp, Homo sapiens
atattttccacaacttagaagttacagtaaatggcttccagcatgggaccacttctgtacccattttttaacactaaacaaaggcaatatgtttttcttcttttaaacgttgaaaccagaatatattttaacattacttaaaatttgaaattttttattttttccaacactaatcaggaatgatttctgttttctttcccttaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtata

SEQ ID NO: 7470 - DNA, 1141 bp, Homo sapiens
ggagtaaataagattttgtttttctaaaccaatctagctaggttaggattatacaagaaattttcatttccttaaaatttagttaattagcattacttattagttgtaagtattgctatgagtttgagcttgttagccttaccatatttatcttactgcctttacatatttaatgttttgatcaagcattttaattgatttttaaaactgcatagatgtaaactaccaacaccgattctaaaaaatgaaaagcatttaaagaaactgtttttgacagcatgcgttataaaaagggccagccacaaaaatttaacattatgaattgataagagaaaaatgaagaaagtatagggcttttttgaagaatataacatattaaacttcatttcagctcacatgagcacaagtactagagaggacagcaaatgagcaccattcctgtgtgtgaaatgtacatgcttatatagacaactttttcttaattctaggaaaacagacagttgctaaatgaaagaattaaattagaaggtattattactcgagtagagacttatctcaatgagaatctgagaaaacgcttggaccaagtagaacaggtgtgtatgtgtttttttttttttttttaagggctccttggtggccatgacctattgcaagtggttatatcagaggctctgattgaaagcatgggctttggggacagaaagcttagtgtcttgtgggccttgggttggaattctgccacctagtgtgtgattttggacaagtcactatttctaagcctcagtttcttgtgtgaattaagcattatcatacttgttttatataattgctatcctgacacattctaagtactttgttaatattttttcagtggtggttagatgcttagaaattttctagtaattgtgtcttttttttcttccctttaatggatacttctaagtatttgtaattatatgatgtatttatatttttttgttttcttgaatgtttattcagacaatagccatagaaaatgttggcagtcataacatttgaaactaatggaatttgtattttttgttacaggaacttaatgagctgagagagacagaagggggtactgttctcacagccacaacatcagaacttgaagcca

SEQ ID NO: 7471 - DNA, 1136 bp, Homo sapiens
gtttactacagaatgaaatgtccaaataggcagaagcatatgctaatgattttttgttttccattataaacaatgtatagcaaatggaatttaggaagttgactataaatagtaacttttgttttactgaaatgtttatgacaattttgagaccataaatgattcattttgttgataaaatatgaaatacctgacgaaagtttctcatcacttagttgttagaaaataactatagtttataagcattaacattgaataatgaaaattatatatttgagtgactcatatatacttctaattttgtactgacttaacatggttcataaattttcacagaaaattttaaacacaaaacctaaaacctattttggtaggtttgatcataaaaatctatactcaacatataacactggctttataggtattatagcctaattttgtttccccccatcttagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacaggttggttttaaatttgaagtcttgttacaaattgctcagtatataaatttatttatatgaatacatattttctctttatagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatgtttcgctttgtagttaaaacatacacacagaggacaaaagcttccagctcttttcagtttgtaaagattttaaagctgttttcctcattaccaggtgaatctaatacatgtgaacaaacctagcatataggtt

SEQ ID NO: 7472 - DNA, 1199 bp, Homo sapiens
agtcttttccaaaggaattagaggcatgctttttttttttaatggaaaaccctttaaaagctaacacgtaacgaaaaaataccaagtttttaatttttttatatattgactatagtcagaatttgtatctgttttcatgtctttttttttcttcattacaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttata

SEQ ID NO: 7473 - DNA, 1199 bp, Homo sapiens; identical to SEQ ID NO: 7472

SEQ ID NO: 7474 - DNA, 1127 bp, Homo sapiens
cctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaatggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccaataaagaatcaatactgcttcacatgttttattttggtgtacattcttctagaaccaggttc

SEQ ID NO: 7475 - DNA, 1149 bp, Homo sapiens
tacttaaaaatatttctgtgctttagtgtttctttgtataaaatggggataacaatgtatctcatagggctgttgtatgtgttatattaatacatgtgaattcctcagaataatgctagtacatagaaagcacttaataaatattaagcttattgttgtggtttcttccactttttaggtcttataaaattttctagtaaagtaacttacattcatacatcttcctattagattgcaagtttcttgaaggtagagccagccttattaagctgtgtagttttaaatggatttttacctataaaggatgttcataaatatttgagaatgaaatcataggaaaatggcaaactctaataagattgtttttcagagcctatttaatataaattatctaaagtaatttaatactgtctatattatatttcaggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctga

SEQ ID NO: 7476 - DNA, 2732 bp, Homo sapiens
gtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacatactcttgatgtgtttgatttgtatttaaaacagtttcctacataattcattatacgaacaattattgttttctgactttatatagcaacttattaaaatgcttaacgataccttacataaatgtatgaacctacagttcatgcttttattattgacccacagctttccaaatttgatcaagcatttggagatgtaggtctgcttcttagctattgctctccttttatttagtaaatattcatattctagggagattctgtgggtttttgtaaagatttctttaagcttggtgctttttgttatatttttacatatttaagtttataaaaagtgttttctccactagt

SEQ ID NO: 7477 - DNA, 1156 bp, Homo sapiens
ctcaattgagagacacacactctctctcgatttttctttaagcattgaagcaggcaacaaagaaagagatgtgtggtatgcatccctacggttgtcaccatgcagggtgcaagggtcctgtgatgatgtggtgactgtattaaagagtacatcaatttgttttaaagtgttttgattttttatggtggcattaagagagagaacattgtggttgcagctttactagaaagcaaagagttctagaagaagaaaaaaaaagtgtttctttgaagcctaccagggctttgaatcttgctgtgccaatgggcgcttaagtgctcccgtaactggcaacctcagatccaccatcagcttaggaactaccatcctctccaaataattcatttaaaggaataggaaaaaaatgtgtaaattgacctaagcaatattaatgatgattgactgcaagtttttctttctttaagtgatttcagattttggatgaacatataacacatgttggttatactgatgtgcactgattccgttgtaaagagcagagatacttctaaattttgcccaagtacagattggcaacattgctccatttaattgtttcatacataataatgaatgctttactttgtatatctggaaaataaacctgactaataaatataggctgtcaaagtataattctgtagggcttcagcttgagacctcatcatctcgtcagtattgagaaaaaggtagagcgatggtgtagggggaaaacctggccttttgttctttacatctgaagtttgctcactgcaggcctccttcccacttcaaatgcaacaacagaaaggaggccttcctcttcttccctcaccctacatgcaccccccagtgctgccatcccgcacagccacgtttccacagtggattatctctttatcagctattcttcccttcactccatccattttccactaaccaatcaggcagccctcttaggaaagactggtgcttacttcaataaaatgttaattctgtacacacagagccacacagccattctagatgttgcttgtaacagaaaagcattcatgtaccccagacatggagaatacctgtattgggtgtcttatgagaaaaaattgggggaaataaagttatgatgggtagtagttac

SEQ ID NO: 7478 - DNA, 1220 bp, Homo sapiens
catttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctaccccactccagaatcaaaagcaatttaattaaagtctcttaagttgtaaagagttttaaatgatccgtgttgaaggcgaatgcctgcaaatgcagtgggtctgacgtcagctgccgggcctgggctgggaggccatttgctattctgtttaaggcaggctggattgtcttattttggaaccagcttg

SEQ ID NO: 7479 - DNA, 1057 bp, Homo sapiens
cctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggtttt

SEQ ID NO: 7480 - DNA, 1138 bp, Homo sapiens
gtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatg

SEQ ID NO: 7481 - DNA, 1180 bp, Homo sapiens
acatttattgaaaacctatactattgtattggcaccatacagggtattgtatttatactagtgagcagaccagggcatttccatcctcatggagttcatggtctaatgaaaatagctggggccgggtgtggtggctcacccctgtaatcccagcactttgggaggctgaggtgggaggattgtttgagcccaggagtttgagaccagccagggcaacatggcaaaaccccatgtgtacaaaagattaaaaaattagccagatgcagtggcacatggctggggtcccagctacccaggaggctgagttgggaggatcatctgagcctgggaggttgaagcttgcagtgagctatgattgccactgtactctatactccagcctgggtgacagagtgaaaccctgtctcaaaaaaaaaagaggaaagaaaatagctaggagacaatcagagcagatcttgggcttctgtggctcatctcagccctttataactggcctgagaagagggtttatctacttgtgcaagtggcccagaaatctcactcgtacatgaggctttggaacatccttgcaaaggtacgctgaaagcaaattgctgttttcctggtggttctgcacgtttcctaacttttatcatagtttgattttcattatttaagaaaaaataaaaaatccaaagaccataagatggcattagattttttaccattaaattattaatgcctatttggtgctcataaagattaatcatgtcacgcatgtttccaatctttcttttgcagtatattattttctaaaaattgttacatgcaaatttaaaccaagatttatcagtaaaagaaaaaaatagaatccttaataatgtaaatgttgttatatatgctaccctggtgaaaatatttttataaatcatgttgtcatttatgctttatgtagcctatttttcaataacctttttttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccatt

SEQ ID NO: 7482 - DNA, 1223 bp, Homo sapiens
ggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaa

SEQ ID NO: 7483 - DNA, 1226 bp, Homo sapiens
actgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattatt

SEQ ID NO: 7484 - DNA, 1097 bp, Homo sapiens
ccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgtttttgtaaaattctaattgggaacattttatccaatgataaatctcaaacaatttttaactttttgcacccccagcacacaaagggatatggcaccctacaatcagtgggtctctatagtattctagggagagaacaaaaagcaatgtatctatttgtggaggagagatgtgtagcttgaaaaattcccccaggaaaacctccacttcccttcttaataatcactgcccaaaaggaaggaatgtttatgcacgtctcaaaaacaatttttttttttttgaggcagagtctcgctctgttccccaggctggaatgcaatggcatgatctcagctcactgcaacctccgccccctgggttcaagtgattctcctgccccagcctcctgagtagctgggattacaggtgcctgccaccatgtctagctaatttttatatttttagtagagacggggttttaccatgttgatcaggctggtcttgaacctctgacctcaggtgatccacc

SEQ ID NO: 7485 - DNA, 1151 bp, Homo sapiens
ctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttt

SEQ ID NO: 7486 - DNA, 1191 bp, Homo sapiens
gaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtg

SEQ ID NO: 7487 - DNA, 1114 bp, Homo sapiens
tttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagt

SEQ ID NO: 7488 - DNA, 1560 bp, Homo sapiens
ttataacaaaaacatctcagtatacttcattacttatttaagcgtgatgtcttttttttttttttttttttttttttttttttttttttttgagacagagtctcgctgtctcccaggctggagtgcagtggcatgatctcggctcactgcaagctccgcctcccaggttcacgccattctcctgcctcagcctccggagtagctgggagtacaggcgcggctaattttttgtatttttagtagagacggggtttcaccatgttagccaggatggtctcgatctcctgacctcgtgatccacctgcctcggcctcccaaagtgctgggattacaggcgtgagccaccacgcccggccacgtgatcttattttaaaagaacactgctatagaagaatttacacaccaaattccctgaaagctaaagtattgttccataacttacacttgaggcaatctgctcagtgtgtaaccactttataaaaaataacttaccattgataacctggaaggtggactacttgtaagtagctggtgtttattgattaaaccatggaagttttcatgatacccaagcatgttgctgaaactgatgcatttgaaagagctgttgaaataatgcaaaactttggttttataagaatctactcatgttttaaaagtatttaactctgtagaccacaattatagaaagctcagtaatgctgctaatgacatttgtaaactatatctgtaatgtagtgcaatatttttatatttcactgggagaggcagtagagacatcatagttgtactttagtgcaagtgggggaacactccaaatagcctagagtatagtaaggtacaaagcttcaatgaaaaaagctgtattatattacattactgatgtaatcttgctgccatgctatgtatcaatagctaaaaaataataataaagactaccacagaaaacaagaatatcttcatttaatgaaatctttaaaaaaggtgattgctgcatctctatggaattatcttctggtataatttggccatgcagaaaagcataacaaagtccacttttcctaaacaaaattgctgttttgcagactgccccaaaacatttttttactattgtttccttatggattatcaagtttatgggtttcctttggctatgtattagtaattagactttaaaatatattttctacattagtattagctgagtgaatggcttagacaaactgagcaacattttagcattattagcaatcataataggctatacttcttcatatcaagccttatattcaatatcagaagtacttgaaataagtggctattttgtgatgctgggaggagaaaacacaacctaaaaattttgaggggtactatcaagttctaaatgtatagctgaattttttttaaagcaatttggaaatatttggctcttaaaaataagataaataataaaatgttaagtcccctaaaagtgaataaattttaaatacctacttttaaaaatactgtcttctaaattgacataattgcttttcttaccaaaagaaggagaggttcccc

SEQ ID NO: 7489 - DNA, 1251 bp, Homo sapiens
aattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttataattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaactgacatgagtttaaaactagatggagcagcttttattgctggcaggaaaaagcatggtgtaatattaaggactggggcccaggtctagactccaggactccataaaagagtttaagttcaagcccttccattaatgaactgtgtaagcataggcagttacaaaaggacccatctctaaaatgggaataata

SEQ ID NO: 7490 - DNA, 1175 bp, Homo sapiens
caggctgtatttcagctaggtttgaccaatgtaaagcactgatgggaaataggagtgaactgggaaagccagggttttcttcctcttcccccctctgcattggacaatgtgtctgacagccattctttctccttcgtggcaccatgcttctgacaggacaggcccaccatatttccagcttctgcttgatactgtagcctctggcctctactaataccacctcttcctccccctgcccttccttccagccaaaggttgatagtaacttcttagaactgttactcatatctgagtgtcctcactgtctcctgtttggtactcagttcttctgtcaccaagtagccatcctctgttttaaagggcttccatattaaatacttagttttctgttttcttagagcctattaataaaacagtaatcatcatttcctctggaaacctttcctaactatcatgaaactccttggtaatgcttatcacagttgggatttcgcatttatgtttctatgataatgtgatcagtattgtctccagcaatatcttccgtatcagcaggtaccatgattgttttgctcatagcacgtggcattcagtgggtattcagtaaatgttttcggtatgactaaggctggctgtctgaccatgagccttcatacaacctcaacccttcttcttccagaccttcaaagttttagcgtgacttttagtcacacttctgtttcctttccatcttcaaggctattcctgatgtatgttttaaccaaataaaaatgtttagggtaaggaagtccacaaaatgagagatatactactcaatattaattttgtgaaaagcctgatttttagagtgaggattttagtttacagatgtggtgcattatagtattttatttctggcattactaaacacatcaaaaacatttcttactctatgtgtatagtttaatgtaacctaaataaaatgactaggtataatctaaaattttacttgccttacttccctttcagttttggagagttttagaagtcttgctgaatgaaattgaatgcacctacaagcccacctctgtcatgtattgttgaatgtacatacaaagagtataaaagagcttcctaaagaactgtgatttcaagtaagaatatttgagacagacaaacttacaaatacgttaggc

SEQ ID NO: 7491 - DNA, 1166 bp, Homo sapiens
tcacagagttcagtggactcagggtggggttgatggaggggcgacccatgaagctacacaaagcccagcgctcagaagcgccctgcacgttctcaatgctctgctgttgcacttggtcaataagttatttagtcggtcctgactgtatccattcttctatgcatgtctccactctccaaggtagagcaaatagatactcatttatttgctaagtatttactgagcacctgctgtgtgccaggcactttgctctgagacacagaaaagagttaggctcagatcttgccctctgggaacgtgaattgaagagaaagaaaaggtcttgtagacggtgcccacaaatggaggaggcagaagccatgggaacaccggggaaggggcagcctcaattcagatggcttcacaccagcctcagtcacgtatcccaccccatatccattctaaagataaggaaatgggctgagctgcccaagttctgccagctggtcagtgacaggcttgaaccccagtcatacctctctttccacgatgccatgccactcccagaagcactctatatgatttcccatagcgttaacacaaataccaagggaatatgagcaggtgcatagtatattcacatctgaggattagccagggctgcaggtgctttgtaaggcaaatttaaaggcttccattttcagaatggggctcctgaatccaccaggtaggagggacacatgagtgcagagctgagtgtgggatagagaacctgaaaccagggaaagtgcttcctagaagcgaatccatattggctctggataattttaattatcctagaagcaattgtgtctggatctgttcctgggggtcacaagggcccctctttggggaataataacggccactctctctaccaaatcttgaagtgtctgcttaatcatttgtttcccactattgacaaaataactgataccaaaaattccatgctcagaaattatgcatgaaggcaatgttaaagtctgcgttatcagccaatataaagtacatggtattatttccatgaaataaaaaccctgtttaccatggcccccactcaactccccagtctggtgggttttgttccacatctgagaacatctctctcactggctcagggaaatgctgccactccaataacctcatta

SEQ ID NO: 7492 - DNA, 1206 bp, Homo sapiens
aaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaattcagttgtcaacatttattacagatacagcggtgttaccataatggatttatatatgagtcctccttgttttttaataaatacctaggatgcctcttatttggtgtattgtagcacatattctgtaagacctacaaacttattttactatgaagatagttctgaaaagtcattcaaaagagtagtttttaagtacaagtgaacattcttcaacaaatgtgtggatgccctctacatataagacatcccctcatagggatggagcttacgatttagtagaaatgatatttgagtatttatatataggctaaggtctctgctgagtacttcctatttatgctttattttatttctc

SEQ ID NO: 7493 - DNA, 1333 bp, Homo sapiens
atgagctaccatgctgcccttgtattttcttatctgtacccagtgtaactacacgtttactggaactgtgtttttaagactgacagttgtttataatggattagtcgtaagtaccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccagaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtatagaaacctttcctctaaaaatccattatgggggaaatattcactatacaatccagtggttttgtctgaaatcctaaaaatgttatttttgagcaggcgagtggtatagatattctcacacttggggccccgatatgggcatttccctttgacttcagtctcatttttttttttttttctgt

SEQ ID NO: 7494 - DNA, 1202 bp, Homo sapiens
agatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttct

SEQ ID NO: 7495 - DNA, 1111 bp, Homo sapiens
atatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggcccct

SEQ ID NO: 7496 - DNA, 1180 bp, Homo sapiens
cattgaatttgatgatacccatgttgttctcataaggcactgcttgtaatcaaggtcaggatgctttgcatgctgtggcagctccagctggtagcgatggttctcagggcattggaaagaggccaccaggttctttagtttctactgggatgacatcgtagcccagtcccagttccttaggttctcagtccccttttacttccctccaccccacatggttttgaggattttttttaagccttttttggggagttgggagaggagtgagaaatgtgtgttgaataaacagattcctgctgttatcaaatgctgtctgctcttcatactttttcctattctgatgttttttcagatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcat

SEQ ID NO: 7497 - DNA, 1671 bp, Homo sapiens
tcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgacccttcaggtattgagtaacacctttatcttggtatagaactgatactttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaa

SEQ ID NO: 7498 - DNA, 1504 bp, Homo sapiens
cccgccttggccttccaaagtgctgggattacaggtgtgagcgactgtgcccagccgcatgtcttacaattaagtagagatgggttttgccaggccaggctggtcttgaactcctgacctcaggtgatctgcctgcctctgcttcccagagtgctgggattaaaggtgcgagccactgctccggcccatactgaagtttttaaaaagcatgtgaaaaaaaaaatccccaaaggatcatatgcttttttattttatatatttttaattgttcttgttgctgtgtagggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtaaaattctatttcctagaatatgcttaagtgttcacctgtaaaagtgaaattctgatggataaatatcagggctgtattgttattttccagataaactggtctttcatctttccttcagtatcatttgcagtgacttcgctgtcaaaagtttgccttcagaataccaccatccaaaacataaataacccaacccctctcttctttagtgatgtgctctttgttttccttctgcttcgatgactgcttctttgaaggctcttcctgtactcatgctttcagtattggtgtatttttcaggttttactgggaaccagcctccttttaaaaataaataattgaaaccaaaatgtactttatatatttatttttgccaactgagagattatgcaaggaggaactcattttactttactttttttgagacagggtcttgctct

SEQ ID NO: 7499 - DNA, 1100 bp, Homo sapiens
accatgttggtgctcagaaagttttaaaattgggagcatttcagattttgggtttttggattaggtttgcttaccctatttagtagagtctgggtagatgtaggttggagtagtgagaaaaggatgtatggatatttttttccttatggtcaaatggaaataaggctattgtataatatttttacatttcctaaattatcacccattgtaacaataaaagcaatgtaggattttattctagaaagcagtgagttatgttaggcattgcttgtttctctttattaacaattgtgcatttgtattacctttcaggaccttgaggaattggatccagattttatcatggctaaacaggttgaacaactggagaaagaaaagaaagaacttcaagaacgcctaaagaatcaagaaaagaaggtaaatgaaagggttggtaaacctttaacataccaagttaagagagattttttaaaactacgtgtgttttcgtgtcattcagattgactattttgaaagagccaaacgtttggaagaaattcctttgataaagagcgcttacgaggaacagagaattaaagacatggatctgtgggagcaacaagaggaagaaagagtaagttttttatttaattgtaatatttttagattgtaataaaatcctctgccagtaatggaaccaaggattcagaattgctttattttgtattcttctgctagaaatggtgctctaatggctgcctatgaacagattggtagaaagagggaaaatttcacaatagagattacaaacgaaacttggaaaacaaaggacaactgaaaagcccattttataaaaaactgctttatatacactttaaatgggtaaattgtatggcatgtttatacatctcatagttttcattttacttgcagaattgtgcagccatctccacaatctaattttaaaacacgtctcaaaaagaagttctaaacccattagcagtagtcatccctattcttccccaccaccccagccctaggcaaccgctaaactactcctttctctagatttgctgattctggacattttatataaatggaattgtgtactgtgttgtctt

SEQ ID NO: 7500 - DNA, 1100 bp, Homo sapiens
tgttttgcttactgtaggtcagatttaatgtactacaatatgttgtcccagaagtgaaagacctttacaattggcttgaagtagaatttaacccattaaaactctgtgagcgagtcacaaaggtaagcctttgtatttaagttctggttgttaccacagagttggccttcttgcagttttgggttgtattcatatttgttaagagagaagttttgtcctatgtgttggaattcagtgcacatttcattgtcttttttctttatttcaagagaaaagatatatctgatgtgctcagcaaacctttggaggttaattagcagcatgactaatttagccattgctgccagtcaccttcaaacaagtatcagtagcttcatgatacattttgtatttctttgcattggatgatgtttttgtatattaaaaaaaaaagagttttagatgttttagtatctcttatgtagaaagtgtgattctctttcaatttaatggattttataggttctaaattgggttagggaacaacctgaaaaggaaccggaattgcagcagtatgtgccacaactgcaaaacaacaccatcctccgccttctgcagcaggtaaaaataaaaaaataaaaaaagttttgtgatgttatgtgctcatcatgaaactaaaaactggaaaaatctagaactgcctaggaagtgagaacctccccaagttctgcccctggcaaaaattagtctatttattaatttgaaaatcagaattattatatttacatattttgtaacggacgcttttgttttttggctgaacactgtctttgggcatttttccttgttagtaatgtagggctaccttattccatttaaggtactgtggtgtatttattcagactctcttgatgaaaacctgtattcctagattttttttttccctgttagaaatcttgtagcattgagcatctttcatacatgtatctttgcatacttctattactttctgtggcataagaagtggaattagtcatagggtttatggatttaaagctttaatagctattcagaagcctggattaatagaccccccaccatgagtgaatgagacagccttt

SEQ ID NO: 7501 - DNA, 1233 bp, Homo sapiens
ctttttttttcttttttgagacagagtctggctctgtcgcccaggctggagtgcagtggcgcgatcttggctcactgcaagctccgcctcccgggttcatgcgattctcctgcctcagcctcctgagtagctgggactacaggcgcccaccactacgcctggctaattttttgtatttttagtagagatggggtttcaccgtgttagccaggatggtctcgatctcttgacgtcgtgatgtgccccccttggcctcccaaagtgctgggattacaggcgtgagccaccgcgcctggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgttctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggttagtattaatttgaggatttttgtagctttgggcagaaaactttgtggtcaggtttaataactcatgattaaatactgggaattctgattcagtgccaagggttctgatgtatggacagggaagcactggtgtcaatcactgttcacttgaggcagttccgcgccagtgggtgagcaggggttaaattggtgggagttttgatctagcaggacttgggttggctctggggaataccgtgggccagttagtaagagaagaagtaatgatgggcaagaagagtcatggcttatttcatggaggctctaggaaaactaattaagctgtgtgtggtaaatatgaagaggctaggtgtattagtatgttctcgcactgctatatatacccgaggatgggtgtggtggctcacgtctgtaatcccagcactttgggaggctgaggtaggtggatcacctgaggtcaggaattcaagaccagcctggcaaacatggcgaaaccc

SEQ ID NO: 7502 - DNA, 1152 bp, Homo sapiens
tccttggccgggaacccggggctctagggctgctcgctgctgctgtggcctgcgcagccacgggaggcttcctgaaaggcattgctcggaggggcgggggcggggaggcctagcctgccccacagacacagctgtgaggcctgggtcatacacataccagcaagcagctgccgagacaaatggtggtgggaagtcctgggaacacacacagcctttgcattgacagcacaagtaggatcagagcccaggtgagcccctgaggataccgaggccttccctccctgaggcccgcaagtctccatgcgtctcccgggagcctggccccgctgcagaaatcccttctcttcctccacaccctgtcctttccccaaaggctcgtgttatcagttccagctacccatcgactttcccaccgagccgctgccctcaaaacggagggggcaccgcagcctccttgagcctggcatcccaggccttgccaaaggggacggtggcttcctggataattggaaatctctgagaagaagaggaaacacctgagtgacactcagctgtcctctggggtcccctggtgtgcatgcacgtcctcctgaatacctgtacttccaagaggtggtctcctgttttcataacccaacactctgagataggatcttccaactttttagccccggctgtggaaagatagtgagtatgaagtctttgtgcatttggaagtgacatcgctgtgtggattatgaatacagagagctgccatcttcctgatcacaatagaccacgattgcaaagcctcctctcccagagaccccttctgcgcctgccctccccacccaccacccagctgttgaagctcagcgtgtgcaagtcagaccctgcacaggccgggggtgtctcacctggcctaaacgtaaaggcttgtgccggagacagtgattgaaaacatttgaaaagccagctctccctggcagagaaagacacttcccccccaaagtggaatttagatgtctttccctagtccatcaagaagtcatttttgtaacagtccctaagcgagtgttctcaattagaagagtttagtggcttttggtgttgttaaaataataagaatccttctagcatccaaagctttctaatttttttcagggagatttg

SEQ ID NO: 7503 - DNA, 1562 bp, Homo sapiens
aggtacaatgtttggttttctaatcacctctgaggagcttcatcactgttcatatgaatttcatgatacacatcagccatgttttatttgtatgttttgttttatagatcagcttatgagacagacattctcaccatttggacaaattatggaaataagagttttcccagaaaagggctattcatttgtcaggtaacactctacttgaaatatcattattactcttatatttgattcattcctttcacttatgttctccagggtatcagtgtttgttattttagtgcttctttgcagtatagaagtttaagctacctacctaatgtactttagaaaaaaaataccaacttgcaggtgtaaactgatgagtttccatgttatttattgtgttaggttcttaaaaaataaaagacaaaaccatatcatttttctttcttagattttcaacccatgaaagtgcagcccatgccattgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaattacttctcattacctaggtggaaaggggggattggggtaacatttagtgtgtcctatgatccctgtaagcagttggtagaatttgatttacatttctgatacacttttatttatttttgcatgtaaaagatctttgtccagatatattcaaaagtttgatggttttatgcctatgtggtatgtgtgagaaatctgaggtttgtgtgatacaaagtaactggccttttttttttttttttttcttttgttgatagagtggtttcctcctttgtaattcccctgcccagggccagcccatagctttattttcagatttcttcctttgagactgtttccaacatgaacttgtttttaaaatttctt

SEQ ID NO: 7504 - DNA, 1151 bp, Homo sapiens
gctgtttcttttctacttaagagtcataattttgagcagcacagattaatcttaaacttctattttgaaataaaaatgagcctagttttttgtctttaaagattgagtagtcaccgtattcattatttattatttcatttttattttcttgagacagagtctcactctgctgcccaggctggagagcagtagcgcaatctggactcactgcaacctctgcttcttgggttcaaactactatgcctcagcctcccaagtagctgggattataggcgtgtgccaccacgcctggctaattgttgtatttttagtagacagggaggtttcaccattggccaggctggtctcaaactcctgaccgcaagtgatccacctctctcggcctcccagggtgctgggattacaggcatgagccactgcgcccagcagattatttattattttacaatatgccttgcagcagttaggaaaagtgttaattttgttctctagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggtacgggtgctttatttctttatgagtttctttaaaaaatgtaggtcctatatacattggtgagtaacatcattcacagtggagcggactttacttacaagacagcttgttttgatgctgttcacagagaagattactttttaagtggtgtcatcactcatgaggtgctaatcgtggcatctgtgtctaaagatagaatatgatttgcagagacacatcacagatctaataaggtgcttgtgtcaagccttcaatagaacctaggccgctgggatttgttgttgatagaagatgccaagcatatggacattttcaaattagtattcagtaaaaggcttgaaattaacctctgatttgtgaaaataaataaatagaattggaagaagtgtcttgagtcttattagccatcttaaatctataatttcttcaagaaattatatgttgttttatataattgtgttaaat

SEQ ID NO: 7505 - DNA, 1150 bp, Homo sapiens
gggctcaagcaatccttctgcctcggcctcctgagaagctggttctgcaggcatgcactaccatgcctggctaatttttaagttttctgtggagatgggtctcaccatattgctcaggcttgtcttgaacgcctgggctcaagtgatcctcccacctcagcctcccaaagtgctgggattacaggtgtgagccaccatacctggcctatgttattagcttttaaatcaaggtgtaatacttctgatttaattgtataattttcaacataagcattggaaaggtatcgatttgcttaattttggtggttaatgaacactagcaagactccttcaaagtttgttttgggggaacagtactaataatttataaactctccgtactctgaggtatagcttattatgtgttaaactacttagcctgtagtggaaaagaatttgttaatgagctttgtcataattctgttgcatcttgaaggttattgttcagttccagccctcctcagtgccagatgaatggggcaccacgcaagatggacagacaaggcccagggttgtaaagcgtggaattgatgataaccttgatgaaattcccgacggtgtgtatagtttgtttagaactgaggtctgttttagtcctctccattttagcatcattctttagaatgatgaagaaataaacagttattagaatgccctgccacagcagccattgcaccaccactcccagctaatatttctattttttgtagagatgaagttttgccatgttgcccagacttttctcgaactcctgagctcaagctatttgcctgcctcggcctcccagagtgctggaattacaggcgtgagccactgtgcctggccatatctttctttttgattttattacttttgtatctttattttttaattgatacatattaatggggtacacctgatattttgataaatgcatagaatgtgtaatgatgaaattgaagtaagtattatgtctatcacctcaaacattcatcatttctttgtgttgggaacatttcagatcttttctcctaggtatttttctttttctttttcttttttttttttttttcagacagggtctcactctgttggccaggctggagtacagtggcgtgatctcagctcatta

SEQ ID NO: 7506 - DNA, 1280 bp, Homo sapiens
caggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcagtaggtataaaatgggcacgactagataaggtcaaatggggatttaactttttaatgacttctcaaagaaggagctgcagtgtcacttaaggggatgcgcttttgtctttcagagggcgttcagttgctctgcctgatagataaggctgcagacgcctgccgctacctgcagacatacggcgagtggaatcgggctgcatggctggcaaaagtaggtggttccaagtttcaataggtgccctcaacattcgggatagaaagctcagtcctgaactttggacttatgacttagaaacattttttggcctgcaaagctgctttgcaaatactgtcttggaacctttatccttttcctattctttatgagtgtaaattgcattacttatttaaaaatggatcttgcattggtagcaattaagtaaaagcagctgcctcctctttctcccagagtctgagccgaaactacagtccagaggtatagccaggccctgggtcccgtaggcacagaccgttatcattattcagagtatgcagcagcttcagggcagtgtgctagtcaagcagagcatagcctgtatttcatagaaacagatctcactttaactgaattattattttttctttatagagtgcaggatgtttttgttgttaacacaggcgtctttctcaggtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcgg

SEQ ID NO: 7507 - DNA, 1286 bp, Homo sapiens
tatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccaggcctttgtgttctctgcattgctgtgcatgaggccaggtcatgaggtggctccttaggagtcatctggtcgcccagcctctaaagcctggctgctcctgctgtatccagagaaacctgtatgtgggaatcccatgggtgcggtacagggcaggaatgacacccacaccccgggcaagtctacctctgagttcccgagtgggaatgtggcttagtgcacagcttttggagatgagggggtgagcacttccatcttttccctcctgagcctgctgggtgacacatcatacccactaagaggtacaatt

SEQ ID NO: 7508 - DNA, 1112 bp, Homo sapiens
gctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagagg

SEQ ID NO: 7509 - DNA, 1195 bp, Homo sapiens
atcccttacccactcttgcccttccgtctaagtccccaaagtccattgtgtcattcttatgtttttgtgtcctcatagcttagctccctcttataagtgagaagatacagtgtttggtgttccattcctgggtgacttcacttagaataatggtcctcaactctatccaggttgctgcgaatgccattattttgttcctttttatgcctgagtagtatagaaatggaaggacatagtttaatagtgattttcttatcctgtaaaatgctgtatttcctactgtcaagtattaaaacaagtaaattgaagaaaacataaattgatttctctttttgaattttgtatttagtcagtatttctatgatgaaaaagttttgcagcttaatatagggtgtgactagggatgatgatggaaacaaagaggaaagttaaggacttattaacctgaggaaaatgaaagtatatattaattataagattattttaatattaaaaaaatggctgtttgtgcctctgctttttcttaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacggtaagattgctttttgccgttattgtagtgggttatatagaacttcaaataattactcatttgattatatttaattatgtaacagtagaagtcctaattgacagtgtattataatgatttgttgctagtctcttacatagaatacatactactatataataggtaataggtattctatatgagttaaatactcctatataatatatacttatatataatttgtaattttcatttaagaatatatttaaagtcacattgaattttaaaataaacatcatttaactagtttataggaaatatacatattatataagtatatagttatgtaatatataagtaaatattatgtataactagtatctataatctataatctctagtacttttatattgtatttataaggtactatctttagaactgatgccagtgtctgatggtaattctctagctttttaaggtatccatctagttaagaagtcattgta

SEQ ID NO: 7510 - DNA, 1198 bp, Homo sapiens
taggattatatagatgaatgtctcatatttaaagaattaattaatttgcctaaggtaacatgagtagttagtggcagagcaatgtcctgaaattgcagtgcttttttttttttttttttttttttttgagtctgggtctcactgtgtcgctcagactggagtgcagtggtgccatctcggctcactgcaacctctgcctccgaggctcaagcaattcttctgccttagactccccagtagctgggattacaggtgctcgccactaccgcccggctaatttttgtatttttggtagagatggggtttcaccatgttggccaggatggtctccaactcctgacctcaagtgatccacccgccttggcctcccaaagtgctgggattccagtcgtgaaccaccgcaccccagtctgcagtgctttttatactagacatgatgttgccatttgtaaaagttaaagtgggcctcagtaaaatatggagtgattgacatcagtgagtgaagtgttcattgtaagcaaattttccaagcattggaaacgttttttattgctgagatattatgtactctaataatttaaaatgacaatgttcccaaaatgtcttgtgttcttcctcagcttctcaaacagaatgccgagcaggacttgcctgttgataatggctctcatattttcctaggaatattcttctgctcttgtcgtatttcagtgtgccatgggctactgcttttatctctaaagttactctgttgtcccctttatcctttctctttcttgctgacaattcttgtgttagtttgtctagtattagcatttgttccctttctaatttgtaatttcttaatatgctcgttaaaatatggagcacctaagtactgtcgaggcatttggtaactgtttaatcagtgagtaaatcagataaagatctcttgctcttgtggaacttgcattctgggggtgtggttgggggagaatggtcagagatagtcattaaacaataagcataatacatcagtaaattatacagaaggttagcagggggtgttgtgggaaaaatagagcaggtataaaggagggttggaagtatcgattattggcttggaaactagatcaccaagtttattgttagtaaagttacagtcaagaggaaagtgggaaaaggagcttgcaggactcttctgtaagttgggaatata

SEQ ID NO: 7511 - DNA, 1197 bp, Homo sapiens
ctaacagtaggagaactagacagaaagctggcttttaggaagactggtcagctttcattagagattttggtgagttgggcacaggagaaagtttttttttgtttttgtttttgttttgagacagcctcttgctctgacacccaggctggagtgcagtggcgcgatcttggcttactgcaagctctgcctcccgggttcacgccattctgcctcagcctcccaagtagctgggactacaggcgcccgccaccacgccctgctaattttttgtatttttagtagagctggggtttcaccgtgttagccaggatggtctcgatctcctgacctcgtgatccgcccgccttggcctcccaaagtgctgggattacaggcttgagccaccgcacctggccaggagcacgttttagaaggagatgtgtcagttgcctattgagatttttttttttttttagtccagtgggaaatcctggtaagtagttggaaatgtagggaaaaagtctatggataatgtgtattttgtaatgtgaatattttctttcttttttgaatagtgtcccgagcaagagaagcagtcctggatgcccactttcttgttttggcttcagatttgggcaaagagaaagcaaagcagctgcgctcagacctgagctcctttgacatgttaagatatgttgaaactctagtaagttcaaagctacagactctgaataaaaaatgttctgttatatattataattatttactgtgctcatatccatatgcagatgatttcacttcattcttcttttttggtctcagattcctctgtagagatcttaccaatttaaacagacgaaagtagaaccatgtggtggaatcttgggtgggggcttggagtaaaaatctcgtagcattctgtcttaagatgctgggtgctatggtcatttgccaatggccatttttcctctgttcactggtgttctagatcattctcagtgacctcagacctttgtcctgggctggacaaaagcccactctgcgatggcagagctcagctggaattgagttaggcctggcgagagggcatgttttggtctgtctttgagaatatttcaaaaccatgtgaatatgattgggttttgcttttttttttttttttttttttcctttgagacagagtctcgctctgtcgcccaggctggagtgcagtggcgt

SEQ ID NO: 7512 - DNA, 1436 bp, Homo sapiens
gaactgcgtaaccctccttatgctacatctcaaaaaagccaccgaggggtttaccccagacgctcctcacctcagatcacatccttcccgggcaaataaagggaaaggaaccagactagttagtccttcactctgtgctggtcactgccaggaaactacatttatcacctcatttacttctcagaaagaaacatgttatcacctatgttctagagataaggacaccaaggctcagagaggttgtgtaacttgtggaagatcacacagctacagctgggatatatactcagattgtttggctccaagtcatttgtctcactgctttagtggggaccaaggggcctggtggtcccccatctccccaaaaagccccatgagcattctgactggccagatttcaaacatcagcaacttcttccttgtcttcacttgcagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataagtgtgcctcgaatttattttctgggaagggttgagtcttttctcacctttgtcaaataccagatttggcttcgtgctcttctctgtctgggctcatttctttgtccatagacttaaataatatttcctttgttatcgtggctgcatttgtaggatgaagctaatgagaaatactgactttctacttaaataattaagtggaaattaattaatctcagcactggattagctgagatttggtttttacaaagcctcatgactttaggaagcaaatctatttcattttattgagtcaaggaagtaacagactgccactctttctgttcaatcctttagtgtttgaaggtcaacctgaaacccccattcccctctaaagaaagcactgggaaagggtgcacaattgccagtggccggcaggtaattagggcactttggagattaaactag

SEQ ID NO: 7513 - DNA, 1186 bp, Homo sapiens
atcagatcactgagcagctggggccttaaatacagttcagtgctcccagtgtttccatttcatgttttaattctcattttaaaacctgctttaacagcctgcttctgaaaactaccataattatctttgtggtagtatgataataaaattgaaatacaactaaacattctgctcagaaatatttttttaaaagatttttcttgtgttcaagtacataagaattagatttgcatttggaatactttggccactgatctcaggtctgaaaatttaaagtatcttaaaatgtaacactgccatctgcggaaagtagtctcatatgtagcatgatagcctttattatctagatttactatgacatatatgctagttacttacacttttaatatttttttctgatagtattataataccgccttttattagttttctggtagtgataactacagataaataaatagaaatcaatgtttctgatttcttagttgttaagtcattctctctttatatcctttttgaaatatctaagaagtcactttcatagatgttcattttgtaactgcctgtattttatgtgactttttcagcagtcaagtatgagactctctgcaaaaacagtgtctgttgggaagaggaaaagttggagaaggatgtttgtgttttgtgctttgtggtgggggcagattggactatctagctatgactgtcagcacaactttctcttttcctccctctacccagtataggttaactctaatcttagctttgcactgtgttccagatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggttggatatgtgtatttaaaaataaaaaataaaacatacaactttactaacagaaagagacattaacatataaaaattaatatactcaactgctgcaagagtttcaattttatattatgtatttaaaaatttttaagatacaatacttacgaaatgcaccattgttctaataatata

SEQ ID NO: 7514 - DNA, 1523 bp, Homo sapiens
cctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattag

SEQ ID NO: 7515 - DNA, 1246 bp, Homo sapiens
aataaatcctcgtaccgtcagaggataaaaacagagatccacttaatagcatctgatgattaaacagtcaacttaaaaagacaatctttaaattgacaatgcggtatagagagataaccctgctctttgtaacattttgtacactttaagacaagaattagaaaatgtagcatttgtggcagcaaagagagtaattgccttagaagtttagtaatcagagaagatttgtttagtaacaaacctcagagaagcaatcccctctggctgtttctttgacctgtctctatgcggatagcgtctgattggtcaaacattactgaagagaaatagactttgctttctacagatttacatgaaaattgcagaaatcactcaagagtcctcctctgagcagtgactttgtggatctccagtggccccaccatttggaaatgctcagtctgcttttccttggcctccatggggcctgcacctctcctactctgtcctgtacagccccaggagcagagagaggcataatcccccaccttgcacactgcaaccttacactgcagatataccacatcatagctgtcaagaaagctgaagacattgaacttgaactgagccatgttcttctggcggggatggaggttgatgtaggtattgtctttgatgcacctgatggggagaaaaaccccaggacaaaaagattaacttaaagcacgatatgagtttactgcaacccagataatcaggcatggacccagatctctgatttgcaaatagagttcttcccactacccactctttctttcataaagaaactttttaacactgctatgagtggaaaaaccactattcctggacataaatagaaaggaactagaaaataaacacaataaaaccaaaaaaaaagtaattaaattctaggtagaactcttgtcttcaaaaggcctactctgttttgtccaaagagagatgaaaagtgttggtggttttatttgaaggcaaacttggattatttaaaaatgtacatcagtaaaccctagggaaaccaccaaaaaaaaaaaattaagaagtgatgcattcagaggagaaaaaatgagtcacataaaatgctcaattaaaactggagaaggcagcaaaaagagtgtgaggagacaaacaaggaacaaatgcaactaatagaaaacagttactgagatggtagattttaatccaatgatatcaagaatcactttaaatataaatggtctaaatatag

SEQ ID NO: 7516 - DNA, 1246 bp, Homo sapiens; identical to SEQ ID NO: 7515

SEQ ID NO: 7517 - DNA, 2623 bp, Homo sapiens
attctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcactctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtaca

SEQ ID NO: 7518 - DNA, 1225 bp, Homo sapiens
ttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaaatcacagtgaagcccttgggaaggtaaataatgtaatagccagggactgatggtattagttctttagtgtgattatgtgcttctaaaagtccctaaccacttggttgaggacagaccataagtttaaaacattgtataagtgaaagaattaatatagtattgttataggtaaccaaattatagtaatgtggacttgtttttgaggtggtgagggagggcttattttgtggttccatctggatgtcctcttgtctctggaaatcaagtgtgcctccctgccatctctacataccccttaaccagctctccacaatttacttgtttatggttatagctaccttttccccaagttacccaggtgtagttaccttggccttctcattggtttccctcacccacattctttaagtgtctcttctgtttatcttttcttcctactgctaccatcccagggccttttgggtgaatgtggcagcctccaatttctgccttaagtcctccatctaatagagtagtgacttttgaaccttgtagttgtgacccaa

SEQ ID NO: 7519 - DNA, 1235 bp, Homo sapiens
aagaaaaaataagattaggggaaattgtttttaatacctgttgatataagcatctagttattgatttgtaattatgaggacagatatgcttataaaaggtcctgcttttgggcaatcaggagaacctggtaagagaaggaagaggacttgttgggcagattgacaggtgtgccagagtatgaaccaataaatttgtgggtggaattgtcattacttttgtgagacagggattaatctttgtttttattagctctccagaaatagagataaaggtcaggaattggtaactgaaggaatcagtttgaaacaagcctcctctgagctattttgaaacttgctgaatgtggtactctcagccctttggacgtccaagaattgagatctaaaaagcttcttaaggcccagcctcttaactggatgctgagggcctctgagaaaacatggagtcatggctgttctaatggagtcatccatcactgccaactgcttgctggaaaaaataggggtctttcacaagagcctcataaccttcagggattagaagcctgtgccaggctgactgttacaatggcatgccattgaaggtcttctcttgaccactgcttacaggtaatcatgaaggtctgtaattcagggcatacggtgtctttttcttctctttttgctgtttctgtgtcacttctttctttgtgtctcccttccttctttccttcaatcaataaatagtaaaaggcatttgtgcacagcttgacttaggaaaatgtggctggtggggttttgaaatagttgtttgctactccattatgccatttggtccaggtggtggtgggtggcaatggataaatgagcctgttggcatgcccataagcccaagagttggatctgatctagcatgcatatgccatgaaggaattgtgtcttttgaaggcatggtgacagggcccattttacttatagtacagtgaaaccttgaaacacatgtattgtggagagaatcttccaggcagtagcttaggagacactcttatcctcacttttgggcccagctcaggtttagctgaacatggagtttcagaagataggtatttggggacaccaccaggtgttaaaattgcatattaatcaggtggttattgggatactgtagagatttttcaagtctagtaattttggagggaggaagatgggaaaatattgtgagcttgttcttgaaattttcattctgaaataagact

SEQ ID NO: 7520 - DNA, 1285 bp, Homo sapiens
agctgggactacaggtgcgcaccatgatgcccagctaatttttgtatttttagtagagacgggtttcataatgttggccaggatggtttcaatctcttgacctcgtgatccacccacctcggcctcccaaagtgctgggattacaggcataagccaccgctcccagcccaagcttcccttagttgagcaagttctgttaattttgttttgccaggctgcactttgcccatacatacggcaagggatgtttaaacgtttatctttgagcatgtacgttttactatttttctttagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtctgttttgtgatgattattcaccttaaaaggaagaagctgaggcaaaattaatatagaatgtttaggtgggccaaggttggggactgcagctcgggacacacttccaggttgccctggagagtgctccagagaacacttcttaaagaaaaaaggatagatcagctgctcttataccctctactgacacaagg

SEQ ID NO: 7521 - DNA, 1238 bp, Homo sapiens
catccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagcagcctttgactcaggctttgactgctaggaagaaccgtatgggggaggccaccagcagggtctgggccactgtctctagtcctgccttatgcttgagccactgaatatcagaggtgcgagggacaagggccctgaaacacctcacctgctccagccccttcacttagcagatggggaaactgaggcccagaggggccagtgagctgctgttggccctatctggaacgaggcagtccagggcaaactttggcactgccttccctaacggaacagcctgtggcctgggggtggtgagctttgctttcccgaccaagggcgcggcggccttcccacaggggccctgggaacaaatcactcataactgaagtttcaggttt

SEQ ID NO: 7522 - DNA, 1110 bp, Homo sapiens
tgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccgggggacgggggaaggctgcccatggccacagctgcatcatggggag

SEQ ID NO: 7523 - DNA, 1200 bp, Homo sapiens
ttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggc

SEQ ID NO: 7524 - DNA, 1214 bp, Homo sapiens
cattagggccatggcgtcggggaacacctgcgctcccactacagcagggctccctggagcctttggctctcttgatcattcagagcatgcttatcgtggggcctggggtgcctccagactgcgcctccacagtgggagtgcctgctgtaagtgagcaaacctagacgcctcttggttgtatgtccgcctcccagatcttgggccttgccctgttccagtgggcagaatccaggcctcctcctcatttcctttgtactcataaaggacccatgttcaggtttctctttgccacctgttcaatgtgtctttctgggacctactgtgtgctgggtaccgtgctggtactgtagagcaggaaaaacagaagcaatgccccattgcctgctgctggatggatcccgttctggggctagttctgtttggtacgtacctgctgtgtgcacatactgctcttggcactgaggactgtgtggagcaggatggccatgggcccttctctctggcagcttccatctagtgtagacagatagacaatattaagagcaaagcagattgtgttggacaaagtaagtgctgcaaagacaaggagcatgggtagtgggacagaggcgacgagcagagaagtagaaggatcttctgcgtggaatgagagacctccaaggctggcgtgtgtgggaggagctggctgtggctggggcagagggaccccagcagagaacaggctgctggatattcatctgtgcctgctgaacccctgctgcagtcaggagccccagctctgccattaagcagtccctggatgacagtgggcgttacctggagtggccacgctcaccccaaggagaggctgtctccagagccccagtgctgggcagctcttcctcattcctcggcatcccgtgtttcctgctggtatcgtcctgagaagcttcgtgggatgagatgtcttggtggggaaagccaaggaggtagcaagttcaaggagcccctagtcttcctgttgacacccaggagggtgtggctttcaggcccctccccaggccagcaggtcctgacacctgaattcatgtggaaatgctgagcctctgaatggcctcctgctgtgtgagactgggtggtgtccaggaggtagtcccagggtgtgggtggggagatgggagatgagaatgtcctgaagctagccttgtcacctgaatgtgacaggacactgtggt

SEQ ID NO: 7525 - DNA, 1220 bp, Homo sapiens
tctaacttgctttggggaaaaaaagatttttttttttttttgtgatggagtctcactctgtcacccaggctggagtgcagcagtggcgtgatctctgctcagtgcaacctcagcctcccaagtagctgggactatgggcgtgtgccactatgcccagctaatttttgtatttttagtagagacggggtttcaccatgttggccagactggtcttgaactccggacctcaggtgatgcccccgcctgggcctcccaaagtgctgggattacaggtgtgagccactgcccctggccaaaaaacaatttttaaaagcatgtgtgaggttcaggtgagtccttatatgttacacatgatttcaggaagtcattgttctgagacatggcgtggtggcgtgctcctctgccatggaggagcgtggccagggtggtgtccgtctgctcacctgaggagctccctgggtctgccagcttcctgcctggccaagcccttcccctgcacttgtaagacgacgactgagcgtggctgatcctgcccggtttctgggtggatagtggaacctgggggaaccagggtagaatcccttatgggaggcagccattggcctggccaggctttgggcgctgttggagacagggctgaatttttagccctgagtgtaggcacaggcgagagctggagcccaggcacttgttccctgtgtggctggctgctcatctctgatttagctttggctcaatttttgtcctaccccctgattgctactggagccagcatggtggtcacagccactggtgtcttagggccctggaagagaagacagcaatcccaggttgccctctcctctgctcagggctgatcctggcagacatggaggaggagataggcaggaggagatagggagaagacttgggagggagctgggtcttcatgccaaatgcaggaagaaacaagccatcgttcagttcatgtttgagctgcgtcagcccatgtgaaggcccccacacctctgggaagaactgcagggagcatctctctggtccccgtctccaaggtcggggaagcattttacagttttggaggtgatgcggggaagggccacagccaaaacttcatgtggcagtctagcatgccacacctcactggaatcccgcacgctagaagggagccgccttgtgagaggtgttccagtgaagtggaaccccaccagtaggtggtggga

SEQ ID NO: 7526 - DNA, 1191 bp, Homo sapiens
ataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagaccactttatctg

SEQ ID NO: 7527 - DNA, 1492 bp, Homo sapiens
tttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggtaagtttctgtattctgcattttttgcgtgggatgggaaaaggtagtaaaaatgatatgaaaagagctgggtgcgctgacacacgtttgtggtcttagccacttgcttgaaaccaggagtttgaggctgtagtatgccatgatcggtctgtgaatagcacttgcactccagcttgggtaacatagtgagactgtgtctccacgcacatgcaaaaatgtgagtgtgtgtgtgtgtgtgtatatatatatgcgcaaagtcactagcatttgattcattcagcacgatagctgtactttcaagtatgcatacataaaaatttgtgtatttgtgatcttgtcgtaactttgtactaaattgcccacaattaattgtgttcatgtctctccattactgggggcagtggaaacgtttaagttaaagcaaagtttttacacatcagcagtaaaa

SEQ ID NO: 7528 - DNA, 1192 bp, Homo sapiens
atggaattaatgagtataatttacctttcatctgatcaagtaagttttgtttagtaaggcatggtgtagtttggtgtgtagtcaacttgctttatttttattttaaattaaagacgtaaagtcctgaagttcagtgttatattgtatggttcactgttacagagtgaacaaataaagatacaaaaattttaaaaccttggttctccgcttcctgttccagaatgtatatatttctatatgaaacactttttagaaaataaaactgtaaagaatttaaaagtttattaaattattctagagacagaagatgtttcaagtactcaaaagtttatatttcaattggtcaattttatttaggtgtttattggtaaattacatataaaccattttatagctagaaaataggttcttctccccatgagtattctctaatgacataggtatggaaatgaacatgtatttaaatccatcgtacagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggtgagctggcattctgccctgtttcaacccaggagtgcatttgctggattatttccttgtagtggtgggatactttttatgtcagttatattttctatggaaactggaggaaaaacagttcattttggacattaaaatactttgaacacgtccatggtttctgtttttgtttttcccccaagaaatgagataaaagcaagaatcaatggtttttatacatttttttgctaaattttaaaatagaaacatttgaagctttaaaatgcaagcatttattgtttctataagacacaggcagtatatttgaacatttcaaatgcagcatttcaagttatatatagtagccttaaatattgataaggccgttgctcatctttttagggattgattgactgattgattgattgatccatcgatggaagcagggtctggctcaattgctgtgctggagtgcagtggtgcagtcttggcccactgcatcctccacctcctgggctcaagccatccatccacctc

SEQ ID NO: 7529 - DNA, 1095 bp, Homo sapiens
gacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtgtgtgcgcgcgcgcgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagtttttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgttttgctgtggataatcggtacaaaacgtttccagatctgagacttagatggatcttttaaggtgaaagtagaatgccaggttctactgaaataatatctgaaaggaacaaagagccat

SEQ ID NO: 7530 - DNA, 1140 bp, Homo sapiens
taaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaaggcaggtctgaatccatggtccacctgggttttaattattaga

SEQ ID NO: 7531 - DNA, 1219 bp, Homo sapiens
tgtggccagtctgcactcgggccagcctgcagggagccattgtgctcatgtcaccctttgcaggagcgagcccagcaatgaggaggcaggacattactccctgtgacattgagagcaagtttttcaaacacaaagctcatgttaagaagcctgcagtgcacacaagaagtggggagaggggtgggaacggaggacacgggtggtgatgggaggggcatgtgggcttgtcagaacactctgtgtttgaaaatgtcaataacaaggaagggttttgttttgtttttaacaaaaatcctgctgtacccaatataagcagcaagcactgcggtcctcacctgtcctacaccggccatggtggcccctcgcgggcagtgctcgcctcaggcctcactaagctttgggcacacggtttctctggcagcagctaccagcggggatgccaagcccggactcagctcagaagcaatggaggtggcagcgctggggcgcgggctgtggactcactcacctggacgctctgtttctgtacaggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcaggtaatttgaaaatagatgccatggaagcttctgtcgaaaggtggtagcacttgcttgtgggcacaagagggacacggagggcaacggaggtggtttctggatacactgttgagcagggaagaggccctgcaacaaaccagtgacaagccacgtgaagccccttcctcgggctgagccaggctaagcagagaaggacaggcgctagccaggacccagcttcagaagcttcccagaacctttaaagaggccagcagctcggcacagtccagcctttccaccgtgttgcttcctctcaggatcagcagcaacggccctggcttccagccgtcaccaacacttcccactcccttccctcaaactgcagcacacacattaaaccaccagaccaacaaaactagcttgcagctttcttctttaaaccttggtacaagagtcttccaccatgccagtgtgcctgtaaccggcttttcttt

SEQ ID NO: 7532 - DNA, 1133 bp, Homo sapiens
gtgtgtcagttacatcctaataggttaaaaacttgctcaaatggtcagaagcctgaaagaggcgtcaggaatcctgtgtgaggtaagatgggggatctgtttgcaccttcatctctccatatgagatcttccatatgagctcttccagaaacctctgccccaggctccagcaagcctgtagggcagcggctgctaggcaagggcttgaatttcagtccagattctctggtgtgtgggtggacagtttccttctgggactgaaggagcacttggaagatggtgctttcccttctagagcaaaccttggcattgtcccagctaagctctcatgcccagggcttgggggtctcctgtggcctccatatccctgcacctcatgcagggcacgcaagcatcccacccactcccaaccccccacctccagccgtcgtgcccggcatcttttcccagcatgagaacccgttggcttttctcttttcccgccttgccatgaaggacctgctgccaggattcgagcctcagaccttggacaggtctcgggccagcctcagccacgttctgcgtgcccggccatcagggagggtagagggtgggtttcaccaaggagaaaggcaacccgtgtcggggagggagccgatcgctaggcaacctggagtttgttaccctggtaacggatccatgcactgatgatgctgcggatggacatcttgtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagct

SEQ ID NO: 7533 - DNA, 1134 bp, Homo sapiens
cccctaagtcaagttatatggaagcatgatttatcttctccaaaaaatatgggcccctcagtgaagttaaacagagtataaaatgccttcatggtagttaaatttatactctgttaaaatgatttgtgcactttgcagtaagctgtgatattaagtgcataaatatacagcggagttaacttggaggaacgttttatttgacaggatcacttaaatgctcaggtacagtatcgaaaccatttagcatggttaccaggaatggagggtgagccgactctgtttaaaatctgcagaaaacattcagaatccaaaggaaagcttgtaagtaagtacttctccatggagtgcttaatcgtggaagtggttttcatcacaggagagaggattgcaatttctaaatcagtctccctgcatcatgtgagaaaatgccttgtaaataaactctccattggaatagtcacttgtcctaagcgtggaactgattctattcaaattagcaaccattatagatattttggtcttctattgtcaatgacaatacattttcctgtgggaataggttatttagtccatattgggacattacaggagaattaataattaatgacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccaccttttttttttttttttttttttcctcgagacaaggtctcactctgtcacccaggcaggagtgcagtggcatgatc

SEQ ID NO: 7534 - DNA, 1162 bp, Homo sapiens
cttaactgagtaatcaatttcagtagtaagttaaaatgccttctattaatggacaactgcaaccgttaatcagagttacagtagattaacagttgtcagcatttatgctaatagcacttataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaatctctacttcatcttcactgactccattcattttgctttcagggtttcatcaccttaaatggttttgaaccaatgaaggtgtattcccttaaaaagacggacagcccatcgtgtgaactatagagtttgtggacagatttatattggtgagttattgtgaaatatctccaggtaaaagttcagttttctagaatcccctttgcaatgtgtgttcaattagttgatgagtatggattgcctgcagcctctggctgtttcattgggatgtctaatcgtgggatcatattgattgtctttcaattaattgcatctagtattttcatttatcaaaagcaaaatacatgtaattaactctgaagcaatatagttcagtgtaaagtgatttttgctgctgctgctgctatagagataagtcaacggaaattatgctacaaggaaactcaagtcagaatggaaatagtgttaggatttctcgatgtattaattaaaaagaataaaaatgaattagagaaaccatctcatgacaccccgagtcagtcataagtgatagatggatgtctttaggaagaaggcggcttgtggatactggcacctcttcagtcagcttaggcttttagtgttaccagcctctaggatgtcttgaacataccatgatttttctggcggagtag

SEQ ID NO: 7535 - DNA, 1161 bp, Homo sapiens
ttgaagtaatgagactttaaaggatcttgtttttgtaatcacttgatttcaaaggatacttcttacagcaattataaagtaatagtcaaaatgctaattagacattttcagtcatagctgctttaatgttgaaacagaatttttttctttagcagagactgtatcgtagagttgaaacgctaaatattcttttgtctggcatcagatctctgaactgctctgacattctcctgaaaaacccctagtgccctttttattgcccccaaaagaaaagttaatgagatggtagatttcaagcaaaaaaacaggccctctttcttgcaaaatatgcttacagttgccattgaagttggatgttagccgtgaatgcacttgcctttaatgaaaccagtttaatcgttcacacttgatcaagtataacatgagcaaacaaaggaaataagccagcatatttctgtagagtgtaagtgttgatgttgggtcaccccctccccctaccctgcccccctgtaaaagggagagagggttgaaggcaaagggaatttatggcgctgattggttttttgtgccccaggggtaggggaccccagttacatccctgtggaaagcagttattagagggaattaaaagatcttgggtttggagcttgttttgaacctgactaggtggtttgggtttaattctttttcctgttcagaaagataaggtaaagaataccgactcccccccgctctttttttttttttaacccccacctgacaaccccctctctaattgtaccttaataagagtctgcaggttgaatgcagaaccctgtgagttatttacggtttcgcctgggagctttgaaactgacccttgaatgggtgttctcctgcggggaggggcagggtgaattaccttttcttaactgattttaaaaagcctcattgtccctaaaaatcatttccttgcacgagttgcaatttatgtgtggaactgaatcatcaattccgtgaagagaaagatattcgtaaagtacatctctctaaagttaagaaagtaagaacgtttggctagttaaaaacaaacactactgccattgtaaaaaacacgccagtgacatacttggtgagatattttggccttttgagagtcggggcacacctgttcctgtccct

SEQ ID NO: 7536 - DNA, 1264 bp, Homo sapiens
ataaaaggaatgagtactggatttcattgatgtattgaaataaatgtgtagaaacaggcccatgagcaatatgtaaaagaaggcaggtctgaacccggcaggagaggaatgcctgctgctctgtgaagagtgactgttgggctgtcactgtccggttttctggacctctgaattgtcggtaggcattgctggtcccttacctgtctctttttcttttttaaccctagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtctttgtatttttccaatttccattcttcacattgagttttgatttgaactcagtctaaaattaataaactttacaaagcaaagctcaaaacattaaaagtaaaattctgctgtccactaaattctccctagaatattttacttattgctgctgctacatggctcttgtccagttacacacaaacatcccctgttc

SEQ ID NO: 7537 - DNA, 1201 bp, Homo sapiens
gtggagccagtccctaggatcatagaacaaagggcagggggttctcttttttccccttctctcttgctaatgtgataggtgtaagtggccctcaagcattgcctagcttcactaatggtcaagactgacaagtgttctggaaactcatgagttttagatgaaacaatgctgtgggccagcagagaagcaaggcttggctccagcctaattgtgtagaaaacaaatgaaaatgctttatttcatgaggtttatctcttctggatttgtattatattgagaatctgataaaagaaaatgacttaatctggtacaaagaaatttcaatctgttcagaatctgaaaagaggaacagagtcgaggtaaagcgaaatgaacaaggtcacacagtatttaagatacaatgctttccaagatgatggtggtaaaactgtgacagtatttaaaatacaatgctttctaagatggcggtggtaaaacaaagttttgcttttgaaaagtgaaaagataaatgaggcctacatcccaagacttggttttatactcttggtattatactaaatataacatttaaatattttttcttttaaaatagcaaacggatgtttcagaagacagcaatgatgatatggatgaagatgaggtttttggtttcataagccttttaaatttaactgaaagaaaggttggtttcactggatggcatctgaatggttatttcttaggccaaaaccacttttatttaatgcatggtgaaaatgtcttttatgttaaacagtgatattaactatagggataagtgctcttgtgaaatcttattgtaatcctttttcaatatgaaggtggtggtgttgggtctgtacccagttaaagttgtttactccctgtggtttagggaatcatctggctttgcagtcctgatgttggtactgatgcaggagctgtttgtgctgtctctctgcagctgttatctttgctacttgtgtagtggggatattctcaggctttgctgcctcaatgttgagggcatttactgacattttattttgtttcgattcatctctttttattgattctctgatgagttgtaataaaaagtaaaccagctgcttacccacctcagaataagatgcaggctacacttagtctttaattttgaaataaactgtccagttacttccatctatctttatgagatggacta

SEQ ID NO: 7538 - DNA, 1124 bp, Homo sapiens
aaaaaattagctgggtgtggtggcgggcgcctgtaatcttagctacttcggaggctgaggcaggaaaatctcttgaacccaggaggcggaggttgcagtgagctgagattgcgccattgcactccagcctgggcagcaagagcgaaacgccatctcaaggaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtgcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagtttcccaaatgcacttttaaagcttctacatggaaatcatttcatggtaaatgtcgttgggaataatgaattcaagtgtactaggtgttaagtatgttgctacaaaggaatggaatatttagcaggtgaatcttttaaaatagggttgatttctctgttcacaaaattttatagagaacctcacataatgcatgattaacagagacagaacagagtttcttgcttgtgaagatctgattgtcattttctgtttccagtggaccttctggggctcttgaaatggcgctccaacaccagcctgctgcagcagaacttgaggcagctgatgaaagtcgatggtggtgaagtagtgaaggtaacatggagcccaaagggactttttgggtctttttttttttttttttttaatgtatgttaacagaagtaggcagtgacttcaaaggtagtataggattgtggttatactccctttaaaaaatagtga

SEQ ID NO: 7539 - DNA, 1103 bp, Homo sapiens
gtgtctgggtgggaccaggtggtctacttcagggactttgcatgaaccgtgacaggccaggtcctgccacctgggagcctgttggcagggaaatattcggctgttagcagatggcatcaagttttgaccttcgcaaagaatctacattctgaaaatgatgggaaatggtgcaaaagtaacaaagtggtacagatccacatagttaggagttgattaatcccttgacatccagaccagcatgccttttggtcaggttggttttgtttcccactgtttgcatgtgacattttctggtataaagtaagtggtggctggcacagccaagcatggagaggattttactccttaaagggtctctgatctcatgctgggcatgctgggcgtcctctctcccaaaggaaacggatgaggctcatgctgggcatgctggacatcctctctcccgaaggaggcgggcgaggctgttgctgctgctgtggttccacagcactcctttgcgagcaggagtttgtggtttgcttctttaatcttggggctatagcagtttgagatcttccatgccatcccaaaagccccctgggtgttgggaagaggctgcacagtccaggaggaatctgaaccaaacacctgacccagcctttcctctgatgtccttgctgtgtgatcacctcacccatttatttttatttttctttaaattacagtttcattgagatataattcacataccaaaaaattcatccttttactctgaagtttttagtgtcttcatggagttgtacaactattaccactgtctaatttcagaacactttcatcatcccaaaagaaaccacatagctattagtagtcactttctcctcttcctgtaaccactaatctgcttcctgtctcgatggatttacctgttctggatattttatgtaaattgaatcatacgccctgtggccttttgtgtctggcttctctcacttagccttgtgtcttcaaggtttattcatgccgtagtgactatcagtgcttcacacctttttttgttttgagatgaagttgtgctcttgttggccaggctggagtgcaaaggcgcaatctcaggatcttgg

SEQ ID NO: 7540 - DNA, 1148 bp, Homo sapiens
tggtctcaaaactgggatactgctgtgtattccagtttcagaatcacgatcctcttccatgcctgggcaccctggttggtagaaggtccttccttccactcagctgggtcctgtccctgtgtggcttctgcccattcactagctgaagtcctgtacccagtgtgtagaatgagtgagatgcatcttcccagagttgccattcagcgctttgtcaccagccttatgaaaaccggaaagagggttggaaaggccccctgggggaagcagtaggccctctccttgctttgaccctctccatttaacactggtggcatttctttgttctgaattcgctcatccaaaatttttgtcttgtgtatctagtggctgaaaaggatcccgaatggctttataggtagtgctgggggcaaagtgggtatttggagtactgcagagatgatagttattccagtgtgtgggggaagtccggtgggttcacattgtcacccgaccttctgtgtctatgcagtttcttcaggacacgttggatgccctcttcaacatcatgatggagaactcagagagtgagacttttgacacgttagtctttgatgctctggtaagagagctttccttctcatatgcttggataacacagcgttcttccatgctgcagcgtctgaggctggagtcgggggcttcgtcacagtgaccttgaacgcattttcagttgtaaatccaatcagagatgaattggggtggcagattttttttctcttttttttaaatgtaaaactgtagttaggcaaatgtcatttctagggtaagaaaaggtaaactagccaccaacttctatctgaaaatgttatggttcatatcctaacacaggggtgcagatggttctgatgaagattataaaatggcttacattatgttgctaatgaaaatattattgattaatttgacaggtatttatcattggactgattgctgatagaaaatttcagcattttaatcctgttttggaaacttacattaagaaacactttagtgcaacgttagcctacacgtaagttcctactttgttttaaaaccaatacttctttttttggtatttgtgttatttagagtctttttcatgtacttttgtctatgactgtgtatttact

SEQ ID NO: 7541 - DNA, 1102 bp, Homo sapiens
aatccctggcacttagaaagcactaagcaattattgggtttcattatcattagatttattatgatgacttaccggctctttcttggtggaatttattggcatttattcagactttttattgtgtgagttacagcaaaacataaagatttacataatttctttaagaacatcccgcttagaatcagtagaaaggattctttttagtgtgagtaaatttagttaaaactcccttctgtgtcttcaacatactttgcaaaatacctgtttttcctccctgtgtgcagtcatgaactcaggtcagaggactctggcctcctgaagccagctgttaatataccctggtcctgcacctggattctttcatatctgcctcgtgtgcgtgtttactgtaaggtggtgggtggagctccaggaaggctaagagctgtgaggtcctcaagcctgcggaacaagctgtgactagttctttgcacttgcttgctaataaacgtttgtttaaaacattttgttcgctgagtggagatgcccagtgtgtgggcatgtcgagtagttccttacagaccgtggggagggtgcattgcagggcacttttcctggctcttgtgaccaaaacaggagcttgtggggtttgcggaagtggcctgtggactgcagcaaacgtagcacggcctccacgtgtgctcattttcaaaattctgccttttgattgaaatgtggccaaagaactcttctcagattaggctccgtgcttgaatttcagaagatgagaggcatgaatcagcttaccacactgcagccacatctcttcattggcgccagcctttccatgctgtgctgttggggaaggagtgatgcagccattctcataggtggagaaagaaaaatgggagattttgatgagtttcctaatgagacaaacaaaaagtaccattttttctttatgctgtgatgggactgagataagaatagtatcctcatggccgggtggagtggctcacacctgtaatcccagcactttggaaggccgaggtgggtggatcccatgaggccaggagttggagaccagtctggccaacatggagaaacccccatctctactaaa

SEQ ID NO: 7542 - DNA, 1204 bp, Homo sapiens
tacagaattaaaaataaaaaaatctctagttatgtttgatgacctctgagttcctggaactgtcagttccatgttttccgtaaacgttttttttttttttttcatattattgagtctttggagaattaaacagtcttcgctttaattgcactgcacggtagggctgcggatctccccgtgtccaattcacctaatttgtgttttggcacattctgcagctgtgccatactctaaatgtgtgtgcacccctcacttcggggttctcatatattagtccactaactaaagttaaagtaaaaaatcaaaaacttattttaagacatttcttacacaattttgattttttttttttttgagattcaaagaaaggcagggaatttggcttgtaaatgttgcttaatgtttttttctctttttagaaactccagtgtccatagtttaaagtgaatatggctagaatgttgtacaaacgctcctggcttcatccacatccctgtatctcggcagtcacagctccctggcaccttctcccccttgcctggacggaggcttctgagtgatctcctaggccttcctagattgagaggggaaagggaagatcttaagattccagaatattcatttcatttaagcgagggaggcaaatcctacagagctttttcccatttgtgttcatttattggctgtttccgtggattcgagaaagaaacttgaaaatctgttttgttttgtttggtttggttttgagatggagtctcactctgtcacccaggctggagtgcagtgatgtgatgttggctcactgcaacctctgcctgccaggttcaagcaattctcctgcctcagcctcctgagtagctgggattacaggcatgcaccaccacacccagctaatctttgtatttttagtggacttagggtttcaccatgttggccaggctggtctcgaactcctgacctcaagcaatccacctgcctcagtctcccaaagtgctgggatcactggcgtgagccaccgtgcctgaccgtttttttaaaaaaaaatagagatgggcgtttggaaactgagtcactcaaaaggtgaagtagctttgtcccacagatctgttactcagtacaaagttgaaaggaaacctaaattcattttatttgtgtttccagtgtgcatcccagacatttgtttcagaatttgttaaacattgaa

SEQ ID NO: 7543 - DNA, 1113 bp, Homo sapiens
cctgtgagctggccctggcttgcttctgactgagccatgcaaagtgctttcacctgaaaacaaccgtctatctgtaatcatagagccttggtcaggatcaaggtagcagacatttctttgcattgacgtctatttttccccattaaaaaatagacaaaatatttctatataaatctctaaaagacgagggttccccttttgaaatatgccctaaataccatcctcccatcgtaaatgaacaattccttaatatcatcatcaaatatccggtcagacttcacatttgccctatcgtgctaagtgttctatctttttccagtttatctgtgttgggattgaaacacagtccttgcatctggtgactgtgtatctgaagtcacccttggcctcccttttaaatcactgctttcattgtaaatgtcttcgatggattgtgagtgactttacacgtgtctgtgggctggaaagcaattgctctcctattaagacgtcattgacctttcctttaggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacggtaacccgacagggtatctttcctcgctctgcggtagcttcagggacctacctttgccccacctgtagccaacagggctgacggtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctgccgctctgttggacttgtttcctacacatgtcctaatatcccagaagatgagcaggagtccttttgttgtcaggaaacagtccttggtgtccgctaatgccttccccttgccccttgctgactggaactcttctaagc

SEQ ID NO: 7544 - DNA, 1085 bp, Homo sapiens
ttagcagtgatggttaaaggaataggaattcatttactccctgtaaatgaatgaataacggaccttctttctataatgtaaactgtaaaaattagatttgatatatatcttattaggcattgttattgaaatttatcctgaattccttatttataatttgtcagcagagacagtcatttctccataggagcaaagtaccaaggcattaccttgactatcctagatgacaagtctcttagacaattcatcagtgtgtgattttcaaatgatttctccttttaggttactgttgattgtgctccctgttgaattttgaagtttgttttactaattattggaattttgtggatgtcttctcatttctttagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggtaagccatttactgtttccctgttttaaaagacacagaatgttttgatgtattttttgcccaaggttgcaaaggcaaacaaaaagcattatcttcaacagcactctgccagctcccagttacattaatggaaggagcattatgctaagacataaatttggtcattttagttatattttgttgtgtctactttgggaatttcacttcaaatagcaaattcacgttatgaagactttcttcagaaagaaaaggaatttgtctagtggctaattt

SEQ ID NO: 7545 - DNA, 2288 bp, Homo sapiens
tttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaat

SEQ ID NO: 7546 - DNA, 1103 bp, Homo sapiens
aaatatttcctgtgtaatatggaccctaaccacataaggataatccatgttattttattggcgatttaaggcaagaaacagctgtttgtttctaatgtttgaaggaaaaaatgcctatatttacgtcaatgacacagggcatggcaacctttggaggaaccttctgaagcagtatttttaccttctatgatcatttcagcatctaactttgcttaatgatgaccccactatagcaccaaataacattattcttaattgtgcatggctcttataagacagatttatagacacataagtagcctcatgtcgttcagtgaatacgaagctaaatatttagttttttaccatattttatgaggctgtaatactcgattgacatgagacactaatagaatgtttttattgtgtatgtttttatttcaggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagta

SEQ ID NO: 7547 - DNA, 1215 bp, Homo sapiens
taaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattagtaagtttatttaattgtaaatttatttttctaaaagatgaacaccttctatgtagctgtgagaccttcattctttcagtagtgattagctttgtggaagagaatgtaagcacataaggcacagggataagacagacacgcacgctgttttcgctaatagatgaatactgaaggcctaggtaattgtaacaaggaatgacagaagagatggaagttgtcaggcaatcatgaagcaggggttattgaaggagatagggtggccccaaaaatatttgattctcctccatctatcacaaaatagaaaagagaataatcataattgcttttcacatggagtttaatt

SEQ ID NO: 7548 - DNA, 1181 bp, Homo sapiens
ggcctggatcatcatcagatgagcagacatgaaagccgctctcaacaggattagaaaacacagtttctaggggattcttgcagggaaacagacatggaggggcaccatttggtttgtaaaaggaaggtatagccctgaagttggcaagctcttggcctgctggcctgatgcagcaggcagctgagaattgcttggcctgtccatgggggcctgacaggtatctcaaattttaattgccagcacacacgaatcaggagatttcatatttcaaaaagcatgtatggctgctgtttcttttttgtataaggcttaatttgttttttttttcatgttatagctttcctgagatacattttacatactctaaaatttacccatttaaattgtacagcatgctgggttttcatgcatttatacagttgtgtgtccatcatcacagtgtaattttagaagatttaaatctccctcttccccactgcccctgccaaaaaagggaccccagacctaccagcagtcatttcccatccccctccctctggtaccagcccaccactagtctgtctgtgtctgtggttttccctgttctggatgttttgcatcaacggaatcctgcaccatgtggccttttgtgcctggttcctttcccttcgtgtggtgttttcaaggttgctccacgctccagcatgtgtcagaacttaattccctgcggccaaacaatatcccatcatgtggatgaaccacattttgttgatctatacatcagttaagtcagtttcgccttttggtgttgtgaataaggctgcagtgaacatttgtgtatatatgtgttcatttctcttggggtatatatacacacacacacacgtaggcctaggagtaggattcctgggtccgatggcaattgcatgtttagcattttgaaaaacttatggttttctaatacagctgccccattttacattcctgccagcaatgtatgagggctccaatttcttcatatactcaccaacactttccatgttgtctttttgattttagccatcctaaagggcgagaaagatatcttcttgtgtaaaacgggcaaataatcaagctgggaatggtaagcagggtttttattcacaatagggctggttgatgggattcacaattacagaaggccacagagggaggacacactt

SEQ ID NO: 7549 - DNA, 1263 bp, Homo sapiens
ccgctccccccactgaggagtgctgctgtctgctcttgttttgaacagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactt

SEQ ID NO: 7550 - DNA, 1377 bp, Homo sapiens
ccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcagattactgtatttacatatggtttaaaatcagacgtcatgatagcttcttaatgaaaccaggactggtccctattttgacattatctttcctacagcaaactttttagaaaggctgcctgccgccttgatgtttcacctttccacgcttaattcgggtgttaaatctaacgttttcatttgtaaaaatctttgttgatgctaccttggaagcagtcatctctcagtcttacatttggagaatgtggatggcatgacatcagaattcctttatataatttaacttcagaatagtctgagatcatcgaagcacgatggtcaagggaattccgtttttgttttagagcaaatatgtttgctgtttgtctttcatcacaaacatcagtggagtttcagcaccttacagagctcagtgaaccccctggtcaccatcaaagttagcacacaacaaagccaaccacgtgtccccctcacagatgacaatggctgaactctgagtgaaaccacctgtatggccgggcacagtggctcacgcctgtaatcccagcactttgggaggttgaggtgggtggatcacctgaagtcagaagattggcctggccaacatgatgaaaccccgtctctaataaa

SEQ ID NO: 7551 - DNA, 2009 bp, Homo sapiens
aacctcatgcccatgtgcacaagtgttgtgtcgtgcagtgacgtggtggtaaatatgactcctccctccagttcagcttttacgcagcttttcctggtgcgtttgttcctttaacaaattacgaattccgtgacagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaatagtcccgtgttgctttttcttcctttcccttctcctgccacctttgaaatgctaactcaggggagcggcctcctgtatagcctgttatttgagatcaagctcattagaaatcctggaatttcactgtatcacacgctgtcacaaaacactaagccgttcattgagaggagaaacacagccttttggactttctactgtaataaaggatttatccctcaacattttaaaacgggattatatcaacgctttgccttcctcaaaactttaagaagcccctctgctctgagctgagaggggctccccacagaaaagcgttgcttctgcccttcgagttgcttccttgtaaagaaggctgctaagagcctaaaacaaaacgcgccgagtttaagccctttctatttccctttaacgcttccgcaaatgccaagag

SEQ ID NO: 7552 - DNA, 1192 bp, Homo sapiens
gtctttgctctgcgtcttcccggccgcagcgccaggaccgaccccttaggacccggcgggcggggcggggcgcgcggggcggggcggggatggtgggagggtcgcgtagacccggctgggacggagggacggcggcgcgggatgctcagaacgcgtgtgggcggcccgggcggcgtctggccctctccccatcctcgcgcgccgcgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaaccgggggctgccgagggctgcgggggaggggcgggcgcgccccgcgaaaatccgcccgaccgcctgctccgcgttcccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagac

SEQ ID NO: 7553 - DNA, 1104 bp, Homo sapiens
catcaagtacacaggctatgggaatgctgctggccttctggctgccaggggcctcatggcaggaggccggcccgagggccagtactcagaggatgaggacacagacacagatgagtacaaggaagccaaagccaggtgtgtacccccaacacaccctcgggtctccactcacagccccatagtccctgcttccacacccatgtggacccctgtagggtgggacaggatgacaaatgggcaagagcttccagaatcaagcacctgttcctaagtgctatctgggataccagaaggtggcagatggcaggagctggttacctgtgccgcttctggagggaggcctcttcctgcagttgccttgcccacctcaccccactgggaaaataggtggcttgcctcctgtcctggagagtcactaatgcattccccacattccacccactgggaaacagcataaaccctgtgaccgggagggtggaggagaagccgcctaaccctatggagggcatgacagaggagcagaaggagcacgaggccatgaagctggtgaccatgtttgacaagctctccaggtgtgtggcatgaggaggaggggcctgcagctgggagaagggagagctgacccacatcctgtcttgtgagccccaggaggtaggatcagaggagagcttaggatcctggtattaggttgcattgctcacgtttgaaatcacttgccctggaggaaatcccccaggggatgggtatattgagatcagtattgtgccccttttacagatgataactgaggcccagagaaattaagagactgtctaaggccgggcgtggtagctcacgcctataatcccagcactttgggagactgaggcaggtagatcacaaggtcaggagatcgagaccatcctggccaacatggtgaaaccccatctctgctaaaatacaaaaaaaaagttagctgggcgtggtggtgggcgcctgtagtcccagctgctcgggaggttgaggcaggggaatcacttgaacccaggaggcagagcttgcagtgagctgacattgtgccaccgcactccagcctggcaacagagtgagacttcgtctcaaaaa

SEQ ID NO: 7554 - DNA, 1176 bp, Homo sapiens
aaatttgtcaattgcctgttaatgtcttttgcccatttttctactgtgttgcttgtctcctgactcatttgtaagtgtttttatatttccttggtcataattgctggtgggttataaatgttgtaaatattgtttcccagtctgtagcttgtctttgtacttttttctgtgttttggattaagttttccattttaacgcggtcacattcatcagtctttgccttggtagttgatgcttttcatctcacaatatattactttaaaaatcttagccaagcacagtggcttgaacctgtaatcccagctactacagaggctgaggtgggaggatcacttgaggccaggagttcaagaccaccctaggcaacagagtgagaccctgtctctaaaaaaataaaataaacttttaacttaaaaagagagatgattttccttcctgtgtataggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccaggtaacctaggccattaaatccatgtcacacaggagcatattctccaaacttagcatctgtgagttgcttgaggtgacagttctcagaaattactaaggtggggctgggcacggtggctcacgcctgtaatcccagcactttggaaggctgaagtgagtggatcacctgaggtcaggagttcgagaccagcctggccaacatggtgaaaccctgtctctactaaaaatacaaaaaactagccaggtgtgatggtgggtgcctgtaatcccagttactcaggagtctgaggcaggagaatcacttgaactcgggaggtggaggttgcagtgagccaagattgtaccactgcaccccagcctgggtgacagagcgagactccatctcatccaaacaaaaaagaaattactcagatggattcatcctgttttgaagaaaaaaatgggaagatttgtgtaacctttagtttctacattatatttgtctccagcatttaatttacatgaaaatgaggctaattcctcctcgctccttcactgtcccttctccagtccctcactg

SEQ ID NO: 7555 - DNA, 1305 bp, Homo sapiens
ttagtttcatttggatggaagccatttgggaagacagcattattagacaagaggttttggagaaggaaatactgctgttgggtttttctaagagcctaatttaatgcaagcctagggtttgaaccctgcatttaaaagcttatgatgacaatggcactggttgtgctgacggtgccttttaatcttaagataggagctctgatcagatacgttcctggttctgtgatttgagctcacgtcgctcttacatttgctggaaatgcgatcctgtggatttcctctgtccttgtctgctttctttcatgcaagttttttctaacgttcctgtgaaaagaattaacccggcaagtcccgtcccactcccccagctcagaggtcctttttactagagctgccctagagagttagctggagatgtagagtcaccccatcaggtgctgtgccggccgctcggcctgtgtctcctgcgtgtcttaacgtcccttgtgtccggatttccatttcagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttcttcttgtggctctgttttcttgggcttagcttccaggccaagcctgtgcctggaggttaaaaagcatgagttggaaccttgggaagacacggtgggggtagccttggcccttctcctccctgcacatacagtagacgggcagaatccagcaccaaggactaacgaagacgctggtcctatctttattgttagtcaagagagacctaggggtatccactcccttctccagccctctcaggtacctgccccgacacaggcatccatccacatccttgtcaccactcatcattcaaatagccaccagcatctgtgacctggtgt

SEQ ID NO: 7556 - DNA, 1236 bp, Homo sapiens
gaggcccgcagggtccccccttccctccacctggaggcctcctgtgcagctgtagcgggaacgagcagccgagggcccagagggatccgcctcattgtggggagaggcagcggtcgggtggtccactcctgccccagagaggccatagcttggcaacccacctgccttcgcttctgcctccccaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtaaggagggggctggatttgcagccagggagtccagggagggagctcatccctgaggcatggccacgctctcacaggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggtgagcactgtacacccagcaccagccacacagcaggcgacacatggaggtccacggtctctgccctccctgggaccagggctatggttggggaagcacagggactgtggcaaaagggaagaggcctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggag

SEQ ID NO: 7557 - DNA, 1209 bp, Homo sapiens
agcacagaggccattgggaggcacccacagaggtctctgcaatcaagagggggttcacatgctgtgggcttctggaacagaggtccctttgacttcagctcctggctggcagggtggggggtgtctcagcaccctgggggaccctcacccatagagagctctgataggctgacactggcctgggatggcccccgggtccatagctggggccccaaggagtatctcctcaggccacacccctccatccagattttgggtgcagtaggggccttccaggtgcccagggtgtgggtggggaagggcccccaggccccgaggacacatagagatctggccctgtggtctggtctctctgcaggcccgagatcagaaggtggttggtgacctggaagcggcccggcgttttggctccaaagccaagtgctacaacatcctggccgcgatgtggacgctggtgccgccactgctgctcctggggctggtggtgactggtgccctgcacctggcccggctggccaaggactctgccgccttcttcagcaccaagtttgatgacgcggactatgactgacaggctgggtcctgatctggggcactagccccaggacactgaccccaggctgctgcccctggggcccaatactgactccccggagcctggccctccttctgtggggcctccatccctgccccatcctgatcctggggccctccagccccaacatgggcacctaaggctgaaccagtcagaccccggggtcttcaccctaacccgagagttcccgggccctaactctgcccccgatcctgcccctccctcctcacactccaggcccctcggttccacgattaaaagtgcctggttccagaaagtgcctcctggcctctttcctgcctagcgtgggggaaggagctgccctagggaccaccaaagccaaatgccacagggccagcccccagagtcagtggcgggagcgccccccgcagctcagcagccctgcttggccccaactgtccccttctctcagccactgggcggcctgtggcttacggggcggaggcccagagtattttagactaagtttgagagcccaggcctttgatctctgctgctctgtggtttagcggcctgtgctccagaacatcatgggtgcgtcccaaccccacgtgtgtccaccccatctctctgtgcgcatgtgtgtgcgtgct

SEQ ID NO: 7558 - DNA, 1193 bp, Homo sapiens
cctcccacctcagcctcccaaagtgctgggattacaggcgtgagccgcggcgcccggcagaggtgagggctttgggggaacggttgtggggcctggagtgtggaggcgtcagcgcaggcctggcaggagccctgaaccgggacagtggggtcctgcagctgctggcctggggtgtggagacccccaacacaggggaagtctccaggaccccacaccactaacaagatgagccttgtgctcccttgggctctagagaggaagcccctcttagccctcagcccctctttcctccctctcctaaagtaatttgatcctcaggaatttgttccgccctcatctggccccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaaggtgcgtatggccccagggaatgctcagagggtgccgctgagcctggagctccacctgcccacatgctgcctggggtggggacttgtgtgtccctgtgactgtgagtttgtgtgcacctctgtcccgtgtgtgcccacgtcagtggctttgtctgtgtgatctgtgtgtgtgtgtggcttggggaatctgcccagtgcaggtttaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctgaggtcaaggcagaaggaggatgagccccgaggctcctggagagtctgagcccgggtgaggaaggggaggaggtg

SEQ ID NO: 7559 - DNA, 1792 bp, Homo sapiens
gtgagtgcggctggagaccccgtctcccgtccgggactccgcggagccttctccagccccttgggaggccgccccgggaggtccgcgccctgagccctgcgcccccccaccccccaggtgtacctgtccttcgtttatcccaacgactacactcgcctcacccacatggagacggacaacaagtgcttctaccgcgagtctccgctgtatctggagaggtgggcgcgcggccgggctaatgcggggcggggtgggcggggcgggactcggctctgatgccccgccgcgccccaggtttgggttctataaatacatgaagatggacaaggaggagggggatgaggatgaagaagacgaggtgcagcgccgagccttcctcttcctcaacccggacggtgagtgtccgcagcgcccctggcccgcacccacctgcgcagggagcttctaacccgcgtttcccgcagacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccggggagaggaggtcctggccttggcggactcctcagaccttccccagggcccagtggtgtaccggcctgggggctgaggcaccgcgccccaccccagggaagccccagcttctctccttccttcctggcgtcctgactgcccgggcacttgtccagcctcagggacctccctggagccccacccagggctggcgccccatccttgcacctgtgtaccccacttctgtcatcctggacctgggcccagggatgagtccaagctgcagagatcagcgtcagtcgcatccagttgctgcgcagacagccccattccgggggggccaggcagagacccttagggcaaagctcaagacccctgggcccctcctc

SEQ ID NO: 7560 - DNA, 1200 bp, Homo sapiens
ggacgggcagacccacggctcgtggctcactccagctagcagcggtcactctgcaggcctctgctcaggccccttctcagctcttggtgtcttgggctgctgcactgaatctcagatgttatttcatgaacccaaagagttgttgtctcggcttgtcttgcgcagtgaaaagcgcgtgttttacgtgtccagttgctcttaatagcagatacctgccctggacgccagtggcagcatgtgccctctgagcagcggccttcagcttcccaggaacacggggctcttcctgtccagcctcctgggggctggtctcagccctgactggccagcagacgcagggtcatctcggagttacccagctagggactcgcagccagttgctggttgggagttggagagtggagtttaagccctctccttgacgtagagaggatttggggcctgttacgtgagtatttagcaatgctgcccaagctctgacaccatgcttatgcgtttttggatttcaggcgagcccacaccttaaccgtgctcttcatcctcacctgtacgcttggctatgtgacgctgctggaggaaacacctcaggacacggcctacaacaccaagaggtaagctgccctcttgtcctgccttctgaaactgccctgtgccccgtgtggtgggtgtggcacccttactgctcgggctgccgggggctcagaaggccttcaccagagggctgcgtggggccgccggcctctcccttgagtgtgtctgatgtgcagactccagggctgcccttggtgctgcgtggcgttcccggtcagcccccgtcgcctgtcactgggagccaggagtctgtgtcatctccacgtgaccggcagcctgtgctgcgtttcctctgagttttgcatgttgaggttggaacgagctgcagcagctacagggctgagcccttgagtttgggcgtctccgggggtgaggttcctgcggtggccgcgtgctggttccgttagccagcggggctcttgcacggacaggggccgacacggaccgcagaccatctggtcagcagccaagcgagtaaactcgtcttctcaggtttatctccacaggcaggcaggctagaccttgggtgtgtcctctgcctgaattccatggattctgacgccagtctcagaagtgcgtgtggaagagaagctggttttagagcctgtg

SEQ ID NO: 7561 - DNA, 1120 bp, Homo sapiens
gcgtggcctgcgtcccatactctggctgccagccgggtgggggctgcacgcacccgtgggcagggccgggcgtggccggcgtcccatactctggctgccagccggggtgggggctgcacgcacccgtgggcagggccgggtgtggccggcgtcccatactctggctgaccctggcgcccacagaccctgatgatccgagactggtggatgtgcatgatcatcagcgtgatgttcgagttcctggagtacagcctggagcaccagctgcccaacttcagcgagtgctggtgggatcacgtaggtgccagcacagcccccggggcagtcggtgcaggctgaggggcattctcggaacccctgtgcccagcgcggcccctggaccccctcattctccccggggggcagtgggtgcaggctgaggggcattctcggttcccctgtgctcttccggggtcctcctcggggggctcgttacccctcacccctgcaacgagtgctggcccctccctgcagtggatcatggacgtgctcgtctgcaacgggctgggcatctactgcggcatgaagacccttgagtggctgtccctgaagacgtacaagtggcagggcctctggaacattccgacctacaagtacgtcgtgggggctgcgagggcagggccgggtgggggttacctggaggcagcctcagcgtccgtgctccagcagaccccgagcaccaggcccgtccagtgtgcggctcaggaggggtgaccgtggggctttgcctcctggaacctccctctgacctggtgtcactcaagcccggccgcccctcacagtggccatggcgtctgacccacgtacctccctcctcaatccctggccggcctggcgcaggggctgtgggatcattccgtgcttctccctcccttggttgctttggttatgaaatagttgcaggtactttgtcattatgactttggaatttaaaaaagaaacagaagtctaaggaaaggcctgggggacgggggtctcccctcctgcctgtgggtgccccggctctgcctggctctgcagacatggctagctcacggcaccgtggagcgccctctgaggcgctgcagccactgctcaagct

SEQ ID NO: 7562 - DNA, 1400 bp, Homo sapiens
ccacggctgccgtcccagggccagggtacccggcacccacccagtccattccggacctccacagggactaggtgccagctgtccatggggcctgcagtggggctggtgtgggggcaggtggtgacgctgcatcccgctccccagggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccagctccccgtgtcctgctttggggtccagtgcagccctccagcctgccctcatgcccagtgcccacttggggaaaaccacacagaggacaggaggcactcagcctctgcacctgagcaaagacttggcgcctgccccgccccaccccccagagagagcaggtgccagatgcagcccctctcccattctccaggagggtccaggtggcacccaccctctgctgcgcttgtccaagggctggcggccactgggcagtggacacaggattcctggggtac

SEQ ID NO: 7563 - DNA, 1214 bp, Homo sapiens
agtcggggggacataggctgaccttctcctcttcttcccaggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggtcccactcgggaggcaggtgagcccggggacctgatcccctgtcactcccccacccctgacgtgggcagatatgggggtcacagggtctgactcgggaggcaggtgagcccgcggacctgatcccctgtcactcccccacccctgacgtgggcagatacgggggtcacagggtcccactcgggaggcaggtgagcccggggacctgatcccctgtcactccccaacccctgacgtgggcagatatgggggtcacagggcccgaccagggaaagtgctccctccggagcacaagggctgtggagcccagtggctgtgcctcctaaggatctcatgtgtccccaggctcaggctcaggagctggaggagctgaaccgagagctccgtcagtgcaacctgcagcagttc

SEQ ID NO: 7564 - DNA, 1182 bp, Homo sapiens
tcaggcactgtactttgtcatccacagagtggctgttgaagcagctctccgggtgtggaaaggcgaggtgtccacctcaacaggcagacaggagtttaaagcgcacgacctcacagaaaaccagttgtgataaaaattaaaccactgacatttaagaagagtgggtgggaaatgattgccattgacttttttgttttttagctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatct

SEQ ID NO: 7565 - DNA, 1163 bp, Homo sapiens
accagcactttgggaagccgaggcgggtggatcagaggtcaggagatcgagactatcctggctaacacgatgaaaacccgtctctactaaaaatacaaaaaattagtggagcgtggtggcaggcgcctgtagtcccatagtcccagctactcgggaggctgaggcaggagaatggcgtgaacccaggaggcagagcttgcagtgagctgagatcacgccactgcactccatcctgggcgacagagcgagactccgtctcaacaacaacgacaacaaaaaaacaagacaaaaggtgcaggtgacacccagttcctgtgaactgagctgaggcctgggagaggcacgggacagggctgcgcccaggaaccatctgggggtgaaaagccatcgtgacccacgggacaggagacaagcgagaagaagcaggagggaggcagggctgggacgtgttcctcaagttgccaggttagcttgggacttgtagatgaaggctctggaagtgggtaccagaggtgctcagtgtgggacctggttgagcttgcactgcctgtggacagcgggtggagagatcacgtagggggtcagaggcacaggctgcaaaggcagacccgtggtggacctgtcagggccaagtatgtgggtgggtgagatcacatgagccgctggggcgctggtgctggtggaggggttgaggaggcgccaggaggtaggcaatggcagaggtgacgttcccacctgccatcatcatgactgctgcccttccttgcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggtatcgtccgtgacctcacctgtgctcagcacacagttcagacgtggggccctctgaggcggcccagccagagggagggcacagaccacggggtcagacaaatggggtttgcagcctccacctgctgtctgtgtggccttgggcgagtgatttaccctctcatgtttcagtttccgggtctttcacgtggggatgacgatgatcgtgaccctgtgaggattgttgggagaagtgcatgaggtcacagcgcctgg

SEQ ID NO: 7566 - DNA, 1190 bp, Homo sapiens
ttggcatcccacagtgctgggattacaggcgtgagccaccgcgcccggctgcaaacaggcatttttagggcagtttggtgagtgctgggttaatggtatggtcaggactcattcaaccagtatcttttaagcatctgctgtgtgccagagattgccctggacacaggacattctagaactctgggtgacagaagagccacttgcttggcctaggagcatcacaggaagactttgcagaggcagagaggagggtgtgggggtgttggcggcagaaagtgtttctctagaaacactccagcatgtagaggctggagctgcaggacctatctgggatgacaggggcaggaggtggggtgcagctgacctctgtggtaactgccctgtgtgcagatgctgctgaagggcctgtctgcatgccagggggctgagttccatgttgtagggggtgcggtggggtggcaccaagggacataggcaggttagatgtactttttaggaggaaggggtcagagaccaagggcaatggctgtgagcatggggccgaggtcacctgacgatggtggcctgacccctgcggtggaggagaggcaggaatggagctacaagagtgggtccaggaggtgtcctcacctgcggggaggccgagagctcctcgtaggcatagggcacacctgaccagcagaacccacagctgtgccgcagaaggagatagaagccccgtggtggtttgatagagctggggctggctggggtggcgggtttgttgtatgcattttttactgcacgtaaaaggctttactggggaagaatagatttcctctctttttcctggaagagccgaatgacttagacaatggaatagaaatgtaggtcgagcgtgttcatggaagtgttaagatcttcctggttacaagggcacacacctgagggggagtcactttgtttgaagcacctgagcgaggctgttcgctttgtccattctggcttttgttgcttgttaaatgaggctccttctgttgcagaggtgaccacagtgacagtggccaacgtgggggctgctgcagacaatgtcttcaccacgtctgtggcgaacgcggcatccatctcaggacatgttctggtaagctgctccgaggggcacagcccagggcgggtggtgccacgctgggggcctccggcttccccgaggc

SEQ ID NO: 7567 - DNA, 1214 bp, Homo sapiens
tctttccaggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcgggtgaggccccactgcccagctgtggctcctgctcgggcaaggccagcactgccgtgccacgctgccctgtgggtgatccctcccacctgtggggcgagctcatcttgggagacatgagggtgaagtagacctcaacggagggcttggctttcctaacacatctcactcaagtcatcagccaaggctctgtgggctgaaccccacttccagcgtgagccttgctggggccaaggcctggccctggtgggagatgcttgggtgcagcagttcaggccctgagcccaaggggccaaggtgggcagggacatggagcaggcatggaaggctggttcttgtcccccagcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagtgagtgttgtgtgtgggtacctacatatgccaagccctatgagagcccgggcctgggcgtcggggttcaagctgggcagagttaaaactttggtgagaccccaggtctcattcacgtgctgtccagcaagtggggcctgttgaggccatcccagggtggagggtgcatggcacccaggggtgcccccaggatgcttggtgggtcctggctcctctctggcctgtgtggtgactgtggtattggccaccctgtggccgtggcccccacacagagtgcagaccccacaagggcctccctccttccacatggtgccttgtgaggcttcaaggtgcagaaggtagggtggggagacacagctcgtgctctgtttgtttctaggaacgaatgttcaatgcagagaatggaaagtagcgcatccctgaggctggactccagatctgcaccgccggccagctgggatctgactgcacgtggcttctgatgaatcttgcgttttttacaaattggagcagggaca

SEQ ID NO: 7568 - DNA, 1673 bp, Homo sapiens
gggagctggcccgtcctcctgtagtggccgtgtcgctctcagggacaccccatgggaagatggctagactttgtcatctctccgccctccagccttagcagctgtccctgttatgagcagtgacacccccggtcccacttggttgggtgaggctccctgccctgacttgaccttcctgacccctggggtgggccgcagggcctgggcctgtctcaggagcccccaccccgctcccgcagccctctgtgtgtgagctcgtcagggcccccggcttcgcccgcctgccgctcgtggtggaggacttcgtgaaggattcgggcgcctgcttcagtggtgagcctcgagggtgccccctgcacttacagaagatggggtggggggcttccctgctgcagcctgggggagaagcctcctgggccctgggttctatagacccccatggcactgactcagacccagacaggctgacctactgctgaccctgggagcccgcctggagttcgaggctctcagtgggtgaggtggacattgcctgaggttggtgccctcggtcctccccagcaagcgagcctgacgctgtccacgtcgtgctggaccgccacctggtcacaggccagaatgccagctccactgtcccggccgtgcagaacctgctcttcctctgtggcagccggtgagggcaccagggtgggcacattcctgccacatcagagctgcacccggtgcttttgcccaagctttgaccacacgtctgtcctgcaggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccgtctcagccacagcc

SEQ ID NO: 7569 - DNA, 1101 bp, Homo sapiens
ccatcccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtatggccaggacagcactgagggtggcaggccgcgcctcagcccacaggcaggtgctcagggggcctgtctgccccaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggtgagaggcagccatggggcatacctggacctgtggccatagggtggagggggtctccggccaggaggcctcagctcgctgcccctcccatccccaggcctcagtctggaccgctcccgcctgcacctgttgtactgggcccctcctgcagccacctgggatgacatcacagctcaggtggtcctggagctcacccacctgtacgcacgcttccaggtcacacacttctcctggtcagtgccccccagctttctcagcccccctcccccagtctgtacagccctcctcacccccagctctcccaggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtgggggcacgggccggagggcagcagggtggtgaccagagggctggggtggggtgcagagctttgggtcctgagctgcacgggcttccccgcaggtggacgccacccttcggcggctgctggagcggtaccggggccccgagccctctgacacggtggagatgttcgagggcgaagagttctttgcggccttcgagcgcggcatcgacgtggatgctggtagggatgc

SEQ ID NO: 7570 - DNA, 1190 bp, Homo sapiens
cgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggtagcggccgcccttgccccgcagccgccgtggggccccagtgtcccatacaggcgattcttctgcctgatccggccacatgctggagggttcggggagaggctcgtttcagtctagttggcgatttcttggatagagaagtaagccgggcggaggtcgggcgcggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaaagcagggtgggtacgaggcaaaatcgtgattaacaagctttggaagtttaataccagtgagctgcgtaagattgcgttaaaaaaaaaaaaaagcagtcctggcgcatggctcacccggctttggg

SEQ ID NO: 7571 - DNA, 1336 bp, Homo sapiens
gaccttcatccaggagcacctgagggtcattggggctgtggggatcggcattgcctgtgtgcaggtgagggcacatgggggtggcggtcatcttgttggggacacggggcagggcggtggctggtggccccatgacgtctgcttacgcccacccggctctgcacacaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatggacgagctcgctgtgctggtaacagatggtggtctgttctcagggccctcgcatccagcagggcagacagacccacccccgccccgcccagtgtcaggacaaagaagggcagagccaggaggacacaccccccatggggctccagggaagggaggtctgatgccagggacagctgagcacaggcctcagcagaaagaactgaacatgttcctaaatggtgagatggtgtgttcagagcccctgggggagaggaaaaatggtttccaaaacccttctggccatggtggggagcagacgtgggaagggtgcagactgggggccgtgcccaggtaagaggtgtcaggcaggtggggtgggggcagtagggtgagggggtttacatggaggagcctataggccctgctgggggccagagggtaggaggtaccagagcctggtgtctggcagaggtaccctggagatgggag

SEQ ID NO: 7572 - DNA, 1191 bp, Homo sapiens
tgggctgacagtccctttgtcttgcaggagccgcagtgggaggcacgtcgtcttctacccaaccctgaaggtgcgtgtgctgccagccgtgggaccgggggaggggtgggccatgcgacagcacagcaggcactggcctggggtccaggcggtgctgcccctcggcctggaggacatccctgggtgttggggggacaggccccagcaggtgctcacacctccatctgtgcccagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatgggctcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggc

SEQ ID NO: 7573 - DNA, 1106 bp, Homo sapiens
aaaaaggagaatggaaaaggacttctccagttgctcttttctatagtctcacttctgggttgtaaagattcagatcagtgtaaaggtagcgtctccctctacagtgaacatgcgttattaaaccagaggcagcaagtgcagatgacggtggaggccaggccaggagagggcagcaggcaaggtggcgtgtgcagcccacatgcttgacctgcatggctggacgtggccctctggctcttcgatgctggcagggatctgggctaagcatgacggaacttcccagtttttaaggagaagctggaaaaagaaaatctgcatgtgccatctgggagaacattgtaggtttctcggagtaggcctgaggccgaggtggctgtgggctgccactgtgctgctggttggtttaaggttttctttggaagatgagtgaacacaagtggttagcttcaagtgttctgactcttgtgtgtgtgttttctttcagggtgtggtaactgcagccacaagtctgatcaccactttagcacagaagaacccagaagagtttaaaacctccgtgtctctggctgtctctaggctaagcagagtaagtctgttcgtgggggagcagaagtcagggtgggttttgtcttagttatttatttattagcttatttgtagaatgcaaggtatttgatcagtttataaattcagggatgaaaaccaacttggcttctctgtcagccttcttgttgagaactgtcctgtctgtacagaagcacagctccctgttcccatggtgtgagtgagcacccaacaccatgtgggtggaggaggggcacccagtggccccgtgtcccccactggggaagcgtggctggtgcttcgtggacccaccatctggcgtgcacgctaaagcctgccattcagcttcctgttctgagtttgatgcagatggacctgcagcacacattcttttgttttgctcaacatggtaaaatttttgttttgtgtgcagctgttatacattcatgtttgatgcttcatagaattggttgtgtgaattgtccgctgcagtttacctgctgtcctgttgaacacttagctccttgccctctgaggctgct

SEQ ID NO: 7574 - DNA, 1622 bp, Homo sapiens
caccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatggggaaggagggtgggtagtgcgaagccagcacggcagctgactcggcagcaccgggacaagcatttggggtgccccgggcctatggccccctgccctgccctgcccagcccatgggctccagcctggtcggccagcggggactgacttgttcccaggtctggagcagtagccggcaggatgtggccttggctggggtttcagggtgtctagtgtgagtgccagccttgaggagtgatttcagggaggtggcccagccaggcagccacggcactcgaacagaggctatttctgctctcggggaccctcagagcaggcctaccagtcaccctcctcagccctcttgtcccgggaaataaatggccccaggtggcgtgggggggctggcctagctgggccttcttgcctcccaggccctagaagcggttttgtgtgcagtgagctgagctggca

SEQ ID NO: 7575 - DNA, 1118 bp, Homo sapiens
agccctgccaggagcatgatatccgctgcggtgcagaactaatctcaaagctcaaacccaggtaacagtgtaggtaaaacagatgacagggcatgagactcaccccaggacaggcgaaggacccaggccgatgggggcccagaacagtcctgatcctggagctccttcccgagtgggaccccaggggtttccgaggggcttagagtagggcttagaggcttagagtagggctagggacttcctggcttccctgcctcgggaacagctggtcctggaaggggcttggtcctcggggcactggtgcccaccacccctgatgcctgggagacaccagcatcctctgagcatgtgtgcgtcctcctggtcccgagggaagtgactcctcacatcccccagctggcggggccagagggccagcatcctcgcctgacacctatttttagatgctgagacaggcggcttcctcggggccaggggccctgtgagtggagcttccgcttcctggcctaggagagaattcctgctcctcttccctccatgctgccttttcgcccctggaggccacaacggggtcagaggggcagctgctcaccacctaggagggcctgagagggccctacgtcacccagggaggagtctggccccgtccccaacctccacacccaggcctggcactgccccttcttggtgggcagagagtgaggggttggcctgcagggacccaggctggaggggccgttcacctccggcccccagcgtcccttcctggaagcaccttggtgagcccctcccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcctcgtcccccactggggtgcctgggcag

SEQ ID NO: 7576 - DNA, 1655 bp, Homo sapiens
gccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaagggg

SEQ ID NO: 7577 - DNA, 1221 bp, Homo sapiens
tgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacg

SEQ ID NO: 7578 - DNA, 1878 bp, Homo sapiens
aaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcatag

SEQ ID NO: 7579 - DNA, 1213 bp, Homo sapiens
tccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagcactgtgccatgtgggtctttgcaggggaatgtggtggggaaggctcagatgtgctgcacacctgttgggctctgttgagccctgggtattggtggctccaagaccggttgtacagtttacttctgaggccttgaaagctcagtttgaggcagaggctgctgtagcccccccactacacctaagttgctgctgtatgcaggcagcttcactgcgggcccaggggaagactgttcctgcccccaggaggggatcatttctcagagttagtgggactgtgctttgtagatccagaaggctccaagagg

SEQ ID NO: 7580 - DNA, 1249 bp, Homo sapiens
tgttcttggccactacactgggccaccttcagtctacccttgaatgtcagattgacatggcgagggtttttggtcagcctcgttttgtcttggccaggctctttgggcagcctctggggtggctgagattgggagcttagacaccagggttcaaggttattgattttgttttttgcatattttacacatattttttcggccatcccttaaatgtgatttccaaaagaatgaactgtagcctcagcttatactgtggaagatatcatttatggtaacccagggatctttttgccccatacagtacaagttcttaggttccataggcacgctggattaagggcaatttgtaatcttagccagaaatcataggttacaggttcgtaaagttactagcgcagaagcattagcaagatcgtgatgtatttcttaggctattgttggcctccacacaaattcatggagttgctggatgtggtttaaagggtacaagatctctgtgttagataatattggagttaatccattcctctgggaggggaattttgtgtcccggatgccgttactggaaggatagcattgccccttggtgagactgttaggagagtgaaggagagtgagtgacagatggagctcttgggagtggcagctcatcatttgttggtgcagtacaggccaccagaagaggatggatctgccggggcgctccctggtagtacaaagagcaggaacccgctagaggagagatgtgctttccatgagcgccaagggcccagcctacccccagacagatgtgcccttgagaagtggggactgttggcaccaagaggggttgcctccgcggtggccttcctggatggagctgcccgtgttgagcgcactgtgctctgtgtgggcaggggttccagctgcttcccagccctttcatgggcaggcccctggagctccaccaccccaaggagccccaaaaccctcctgctgaacatgccatgaatttgaatgcttgaaggcatagctttaaaaacaaaaaaaaaccctgctttgactgcagggtggtagggggagttagctttgtttttgtcactatttttaaaagtatatttgcagtaaccatttttttcaatgagaatgaactcattcagtcttggctttcattgttgattggagctaattggtgaatggagctggctttgctctctacaagccttgtctttttcattgacagaaggaacccagccagccggcggaatgc

SEQ ID NO: 7581 - DNA, 1395 bp, Homo sapiens
gcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggtattggctttccctttgtatttttgagccttcttaccctgaggatctttatggtggcctt

SEQ ID NO: 7582 - DNA, 1185 bp, Homo sapiens
gagaactgacttcagttatcttattttaagaaattagcatagccatcacaaccttcagcaggcaacaccctgatcagtcagcagccatcagcatcaaggaaagaccctccaccaccagaaagatgacttgctgaaggctcaagtgattaacatttttagcaataaaatatttttaaattaaggtatgtatattggttttttagacataatgctgttgcacacttaataagtgacagtggtatagtgtaaacataacttttatatccactggaaaaccaaaaaatttgtgattttattgtgatacctgctttattgtggtggtctgaaatgaaacccacagtatctttgaggtatgcctgtatgtgcttttacttctgaagtccagccaacattatttctccttcctttctgtcttcctgccatgtcttctgtacttttggaaactatgcacttgtgcagacattgtgctcaatactttgtttcttcagatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtacctgagatcctgaaactgctgcctgattttccttttctcaggcccttaaatcttcagatacctcacaaggccttagtatacacttgagaatgcactgacagagatagcactgtcaaagcaggcatcttgctgaggctcatttgatataaccgtttctgacagctatatcgaaacttaaaaatgctattttatgttgattaccaactagtatgtgcaatagacattcctgaggcttgtccatagacagtctcttccccttgttcagtcctagtttgagtgagaagcccaaagatgagagataaaataagaatggagatttggtgagggtgaggatagctgttttacacatcatttggcatgttttaaaattgcaaatatgggttttaaagtcaatgtcttcggtcagttttttttttttttttttttttggaacagagtcttgctctgtcatccaggctggagtgcagtggtgtgatcgtggctcactgcaacctctgcctcccagtcttaagtgagtctcatgccccagcctcccaagt

SEQ ID NO: 7583 - DNA, 1199 bp, Homo sapiens
ccgcccacctcagccttccaatgtgttgggattacaggcgtgagccaccgcgccttgctctatttattttcttgatcgtgatggtggttttacaggtgtctacatatgttaaagctcattaaaattgtgtactctagatacgtgcagttttaaatatgtcagagaaagaaagaaaaggatacttcaaaataccagaaatgggcaacagagcgagactctgtctcaaaaaaaagaaaaaagtaatgacattataatgaaggaatggaagggtgagaactgtgaagactccctgtatcaggatggtaaaatacatacgccaaaccattaccagcaaacctgttagatcacacaaccttagaagagaaggtgccttgtttctttgtaggatctaaagtctggctgaacccagagatagattgataaaacataggctcagagggagagaaggcctataatgctttcactctcaggttcttttattgtcttagacataagcagaacagttgacatatcagtccaggccgtctcctggctgtgtatgttgactctcaacacgttctttgcagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcagggtgagtgagaagccgttgaacccactgggtacatctagcactacagggcaattccaaaggaatcagtctttcagggttcagtttagcaagtaattgtgtagaatgtgtgttagatccagcgttgtgataaacctcaagatagttaaacccttagcctagactgtttctgtattcatgtaaaccagttaaaactgagacttcctttgattaagtgccaaattataatatttatcacaaagtctctcagcagtctgagaaaaaaagatctctgtgaactgcattgatcagagaaattcttcatagaggtaagagtcgaagaacctgtaaaattggaataggaaataatgaagtggaaatgagagaatatgcccagatgggacaatagcattatgcctgggccaaaaaactagt

SEQ ID NO: 7584 - DNA, 1072 bp, Homo sapiens
tgagatttgtttatgttccttcagttctttgtatttacttaatcgtctcattgtcttttcaaatgtgtaagttattttaccagtgcatacttgtaagtggcttaaatgataaacagtacttttgtagattgatttttatagacagaatttgatcaaagtagatatcatctgagatgacactagccataattaggcttggggaacctgtttaacggttacatttgttatgtaagtaccacagaaacatgatatgagcaagcatttatttatactatgtacttctggaaattgtaagacgaagttgagtgaggtagagacagattcagggtaatcagcttgagtggttgtttgagatgtctattaatttatgtatttttaacatcacagttagaaggatgccctctgtgaagttgttgtaagactttgtctcgtaacattgtttttctcttcctgccttagttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggtggggaaggcatatggtccttctctgcgcctctgtcgccttcctactcactgcctcctaccgctccccgctaattgtgcatttccctttggcttctagcctatgagtattaattgcggacttcccagaaagattgctggttcccgtggaatatgtaatataacataaaatttaacttttaatcaagtaaacaatgtttaaggtcctaaacagagaattagaagacatagtgcggctgggctcagtggctcatgcctgtaattccagcactgtgggaggccaaggtgggtagatcacacccacctattcctatagaataggaaccatgactttttttttttttttt

SEQ ID NO: 7585 - DNA, 1212 bp, Homo sapiens
acaagttctcagggcctcctgagggctgtatcacgaaaaagaaaaaaaaaaaaagaaaccctttgtatagacacctttgtactcctgttttttttttcttttggataaaattctagtgttttttattattattattatttataaagcattttttaacattttgttgattgtaatcttaaaaatctaacatttttttcagtttttaatcttaaaattaaccaattatttgattccatataggagagtatacaatagagatagtaattatctgtttcacagtactgctgtagtaagtattaagtgaatttttaatacatggaactatccagaacagtgccaggcacttagtaaaggctcggtattagttagctattatcattgttattactactacaagaggctaaggtattatttcttttcctttgcagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtcaggttcagattggtgcatgtttaatctcttaccagtcattcgagatgacttgcttgttgcagatattcaacatatggaagtcagctgtttggcattttaagtattattttatgtgatcccacataggagagcttaatatttaaacagttttatgctttagttgattcagagttcacatactctttggaccttagagtatgaaaattgatacatctttaattatcctggtgtagtctaaagaacccaaattttatagccaaagagactatcctgatattttccctggctttgtaaactcggatagattgcttattgttttttgtttgtttgtttgttttttcttgagacagtgtcgctctgtcgcccaggctggagtgcagtgtcgcagtcttggctcactgcaacctcaacctccagggatcaggacctctcatctcagccacccgagtagctggcactacaggcacatgataccacacccc

SEQ ID NO: 7586 - DNA, 1197 bp, Homo sapiens
actttaaattttcatacttcccctggggcgatgaataaaatgtctgtggcttggtttttactctgtaattcatactctgatgggattttgaaaaaatgtttttaattagactagtagttcaaatgcagaattttttttttttttttgagacggcgtttcacacttgttgccccggctggagtgcagtggcacgatcttggctcaccgaaacctctgcctcccagattcaagcagttctcctgcctcagcctccctagtagctgggattataggcatgtgccaccacgcccttctaattttgtatttttagtagaaacggggtttctccatgttggtcaggctggtcttgaactcccgacctcaggtgatccgcccgcctcggcctcccaaagtgctgggattacaggcgtgagccaccatgcacagcctcaaatgcagaattttaagaaatattaaaatgccttttcatttggtcatcttacgtagattttattctaaattctaatttactctggattttgctttttcagatactggctttggcactactagtggaggggcatttggaacatctgcatttggttctagcaacaatactggaggcctctttggaaattcacagactaaaccaggtaggggctttatttgtgatataactggtttgtttgtagctagtataggaattgacttagtggctctgatgtacttaactttttccctccttctccatctcctcaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcagtaagtgggacatcactggagttctgcatctaataatttggtttgcttattgaatgtgttgtcttttctccgtttttctgtgttcatctaccttcttttcctactaaatggcaaaaacaagggaagaggaaaacttcaatatgtactgaaaaggttaataggctggaaaggaagagagtatgtacatttctataaggatagaaatttgaagcactgttatttaagggatatgcagaggaagagcttcctgatgcaaaatggctagagaaaggatgaaaagcc

SEQ ID NO: 7587 - DNA, 1238 bp, Homo sapiens
cgggagggcaggccctgaggagcagggggtgggatcctccagtcttagaatagtcccagtctggctacaaccttcaacccaagacccggattcttcagcaccgagtgtgagtgttccttcatgaggcccccaccccattcctgggtctccttagtggagggaagtatgagtgccgaggggagattgggtcctaggccttttaatatcaagccatctctgtctgcctcagcttgatccagagggaagcccagcttgaggggtcaaggtgtttgggcagtggggttgtgagggggagttgtcggccaggagggagaagagattggaagaagctcagttccctgggtctgggtctgacctggacagagatctcctgggtctggcccaggacagcaggctcaagctcagtggagaaggtttccatgaccctcagattcccccaaaccttggattgggtgacattgcatctcctcagagagggaggagatgtaggtctgggcttccacagggacctggtattttaggatcagggtaccgctggcctgaggcttggatcattcagagcctgggggtggaatggctggcagcctgtggccccattgaaataggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgatcctggcatagttctgggcctcagtctccccttctgtgaaatgggaataataacctttctacctctgacccttctcctgagtggctatgagggttgtgagagtgaggtgggccaccagagctccctgtccaagccaccgggagcctctcttctgtaggctcttcaagaggtggacctagagtatcactgtgccagggggattcctaagctctgaccctgcctgtctctgctgctcctgccccatctccctctgatccttctcctctgcactgtcttccttttccccttatgccttttctaccctttctgctctggcttttccttatactctgaggagccatctctggaaaaggccccactttcccagacccaggtgtcctaccaggccccaagttgtatccctcgtgctgcttaggccacgccctgcaggatgttctctgcggcctccc

SEQ ID NO: 7588 - DNA, 1233 bp, Homo sapiens
aaaacaggccgaagtggctaaccaagaaactaaagaacatttacctgcagtaaacagggaaaagaaaactgaggagagtccagcctctgatgaggcaggagagaaggaagccaagtctgaataataccacacatcatacattatcagtggtccctgtctcccttcttgtacaatccagaggaatatttttatcaactattttgtaaatgcaagttttttagtagctctagaaacatttttaagaaggagggaatcccacctcatcccatcttttaagtgtaaatgctttatttaagaggtgaaatcattcgctggttgtttattttttggtacaaccagaaaacagtgtgggttattgaattatgggaggttttgactgtctttgctgtcagcttaacactccatagatgggggttagtttttatatcctataatacaatgcatattaaatgacaatatggagtcagcagccctgcatttaatgtcttgaacattttaaattacttctattcccatgttattttttagtagaattgtttcctaaagaaaaccagtccttgatcatggctctccctgtcagaattgtgtgtactctgtaacatctttggttgtggtagtcctgttttcctaatcacttggttactgtgctgtgaaagattaaaaatttgaatatgtagtatacatgctattcagttgtgaattggtgggacatatgtaacagcttatcaacatgtgaacataccggtacttgatagcctcttaaggacaatttgcttccaaattttaagctggaaagtcactggaataactttaaaaaaaaagaattacaatacatggctttttagattttcggtacgtatgttaagaattgtgtacaaattgaaatgtttgtactgatcctcaaccaataaaatctcaattatgaaagaaaaaaatgtaaaaatcatttttagtttgcaggctacacgaaaaaaacagtttgctgatccctggactagatataataaatccaccctctgctctggcttcaggtgctgaggaaatctctctccctgacaatccccatgaacaaacggcaacttcgattcactgctcagttttccctcatgctaccatccctatacatggctttcaaacaccctgagaggatcacaaacccagccaaacactcaacagcaggaaaacctctaggactccatttccaaaatagaacacccacttcaatagacttgg

SEQ ID NO: 7589 - DNA, 1199 bp, Homo sapiens
tgcaagtgatgagagttgagtagagcagagccaaaaggaacaacactggaattcttcagtgaatgaagggagttttcccttactggcccacaattgaatttttctttggatcagatgctattttaagtaagtagaatagcccttatggtaaagctattgtcctaggcccatattctgccagttcagcgggagggcagaaggccggggctgggttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaaggcttctgtgttctccaggctgggagggaccttaattagctctgagctacccaatccctgcccccagcccttcctttattacattgatggcaggccgaagccctccataaatcagattctcttctccttttggcctggctgttgaccctagatgctgcctggctgatggggcgtaggttcagtgaccgctctctctgctctacatccgccggctcggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacctggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttct

SEQ ID NO: 7590 - DNA, 1839 bp, Homo sapiens
tgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccactgctggctttgactctcattgtgttctctgtgctgtggcatgatgggataaagagacaatctttcctttgcccagggaaaatgaaacttgaatgcacatgcccagaagctctgtgggcagggttaccagataaatgcaggatgaccagttaaatgtgaatttcagataaacagtttttaaagtataattttctctcatgcagtatctgggacacatttttatttgctaaattgggaaaccctatgtctgggtaaacttgaccctatctatcctataacttcacttacgacttttaaaaaacatatctatttaatttttctttctttttttttgttttttttgagacggcgtctcactctcttgcctaggctagggtgcaatggcgcgatcttggctcactgcaacctctgcctccagcgttcaagcgattcttctgcctcagcctcctgagtagctgggattacaggcgcgtgctac

SEQ ID NO: 7591 - DNA, 1172 bp, Homo sapiens
tcctcacttcccagtaggggcggccgggcagaggcgcccctcacctcccggacggggcggctggccgggctgggggctgactccccaacctccctcccggacggggcggctggccgggctgggggctgactccccaacctccctcccggacggggcggctggccgggcggggggctcacacccccacctccctcccggatggggcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgattgtatgagattaattttg

SEQ ID NO: 7592 - DNA, 1173 bp, Homo sapiens
agcaatacaatagggtaccattttctccacatcttcatcaacacttatttttcatatttttgttttgttttgttttttgagagacggtcttgctctgttgcccaggctggagtgcaatggtaccatcatagctcactgcagccttgatctcctgggctcaaacaatcctcccatctcagcctctcaaagtcttggggttacaggtgtaagccaccacacccagctcatattttttataatagccatcttaatgacttgacaatttcattataatgtgtcttggtgtgggtctctgagtttatcctacttgggacttcctgggcttattggatttgtagattcacatcttttgttaaatttgggttgtttttggccattatttagataatttttcttcccctttctctttccttatagggacttccatagtgcatctattggttgacttgacggtgttccataggtctgttaggcgttgtttacttttctttattttttctttctattccaagacttgataatttcagtgtcctatcttccagttttctgattctctcttcttcctgctcaaatctattgttgtgctcctctagtgaatttttcatttcagttattcttttcaactccagaatttttattcttctttgtaatttttgtctctgttgatattctgattttgttaatcattgtttttctgatttcctttacttatttgttcatcttttcctttagctctttgagtatatttaatacagttgttttaatgtctttgttgagtaaatccaatgtcttggctttctcagggatggtgtctatcattttttcttgatactttgaatgggccatgttttctttctttccttttttttttttttttgtatgccttgtaatttttgttgttgaaaaatgggcatttgactgttataatgaggtaactccagtaatcagattctcctactccagagcttactgttttttgtttcattgctatgttgaagactgtagtactccatttgagacatttccaaactttttttttttttaagacagtgtctcgctgtgtcaccccaggccagaatgcagtggtgtgatcttggctcaccgcatgctctgcctctggattcaggcaattctcatgccttagccccctgagtagctgagattacaggtgtg

SEQ ID NO: 7593 - DNA, 1141 bp, Homo sapiens
agcactttgggaggctgaggagggcagatcacgaggtcaggagatcaaaaccatcctggctaacatgatgaaaccctatctctactaaatatacaagaaaattagccaggcgtggtggcacgcgcctgtagtcccagctactcagaaggctgaggcaggagaatcgcttgaacctgggaggtggaggttgcagtgagccgagatcgtgccactgcactccagcctgggtgacagagcgagactccttctcaaaaaaaaaagttaaatcttacacaagtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagccccagatctgaaaaggatgctgcgagtgtgtagaggtaaggagattcaggggaaagagtttggatgtgaaattactgtcgtgggaagaaataaacgggatagaggctatagtcggtatttgagcatagtggcaaagagggaggtcccagagggagggacatagtgtgctgaagaagatgcggtttgtatttaaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactggggtaagtagaagccatggcctctttgggctggcacattctgatctcctttcacatgccctccccagacatagccacacagatcctaggtgttgatgcctcccccatccccgccatatagttccagttcctccaaccacttcctgtgtttcctcttctcagcataacgagacccatgtccccgttctcatctgctgatgttgtaccttttcctacagttgacgtgaccctgaatccacacacagctaatttaaa

SEQ ID NO: 7594 - DNA, 1141 bp, Homo sapiens; identical to SEQ ID NO: 7593

SEQ ID NO: 7595 - DNA, 1315 bp, Homo sapiens
caatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtttcattttacttttttaatgtggatactagaaaccttaaaattacatatgtggcttacattgtatttctattggacaactctggagtagatcctataatgaaatttctgtccctaagtgagccctagtgtaaaagcctatggactcaggatacagaggaggtttcaaggcacatatgtttatctctacagaacctgcaccttcccagctgccctgaggcatttttatggaaggtaatgacagagaaaagaagatctcaacatatctagaagtgtagaaatttggaagatcatagaaagggctcatgaccagagaatgattctgcagactctggcccctgccgttagtcctcagtctgttgggcacttgaagctccttcatggtttgatgaaacactgatttgttatcaaggctcagcttgggtgtctatggtgagataaagtagtgcagattatagtaaaagctcactactg

SEQ ID NO: 7596 - DNA, 1508 bp, Homo sapiens
agagggtgaagggactcttccctcttctctggatcccagaaggaataagcagcatgggcccaggatggtttgggggagcagcagctgatgtttattagagaccagtacccctatgccagatcttgggggctttgcccccggaatcttttgcttcagcttcagtcgtcactgtcgaactctgaggatagaccctgcagcaggggcagggacatggagtgcccgtcggggtccctggggcccccaccctgggctcctggtggagggctgcgggggctgaagagccagttctctgccagggttggggatagtcacagcttgactcatggctggtcttttccccccctagcttttccctctggtcctctgtgccatcccaatccccttcctagggcctcctcattccatctcaccctccccagtctccctcattccatctctttcaccagagccctgtgctgagtaatggattcctcacatacttaattctcatgccttctccctccttcactttgtccctcccatccatctcatcatcatttcccctagtagtacctgacagtatctggggccccctccagaaggggtttcggcccttgtaggagaatctggtgggtttgtcctctggcccttcctggggaggtggcgtaggtggggctgggacaggtgggggcacatcagcagcttcagttgtatcagcaggtgctgatgtgggggccagaggcggcatgatgctgaggttgggtctgacccagttggccccatggggcaatgggtctttagtgagaggcttctgtggtcccagcacgcccttagactgcagtgaaaacttgaggcaggagaaggcaacaggtaatgaccgaagtagccggaggagctggggctcacgggctgtagacgtcagccccagctgcagccaggaacaagagaagacctggtagatgacatagatgctgtgggtgcttcggagccagggaagagtctgctgtaggctcacctgccctggtggcagcaacaggaaggcaaccttcttgcgcaggtcacccatatgtaggcggatcttgcagggctgtccatccaacattcgcgtctcttcataggctctctctgctcggccatttggtgagtattcccgagtgcagtgggcgaaggcaccctcagatcctgcctgctccaggaggcttggtagtggccccactggtttcagtgccctccggccctgccgacctggcaaagccaggcgggtatgggctgggcgggactgttttaccagcacacccagtaggtcatagcaggctgcatctgacaggaaaggtactgctactgcattgggcccaaagtgctcctcgatgacctgcaggtggccagtttataggtcagggacttagggtcagaagttaactggttgcctactttaaattgacccccaggttcacgttcagttacatctctataatgtgttcagatttatgctttctgcttacctcccagctctccggcagcaaaacctt

SEQ ID NO: 7597 - DNA, 1275 bp, Homo sapiens
acggaagtgggagccctgggaagctttgtgagcagaggcagtacatagagggaggtgttttaaggagttgggatgaggatttggttctcactgggtcttttctgcccctaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatag

SEQ ID NO: 7598 - DNA, 1483 bp, Homo sapiens
gagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagtgagtgcgacctatctgccttcaaaatcccaccctttgctccctgggggtgggggttggaaaaaggagaactatgcagaattaaacttgggtactcacttatgggccagtgctgctaactaaattagaaactgtgtcttaagttagttgaagtcgatgtgaatatacctctgcacaactgcctataaacgacccctttgtgtaacactgactatgccagattggcgaggggagggggaggtctttctatgtgtggatggaccttacctttgggaatggtgtaaagttaaatgcctctgcagttttgcctgactctgctgtctcttggataattctccctctaggagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagag

SEQ ID NO: 7599 - DNA, 1112 bp, Homo sapiens
ctcaactttgtaaactcttgtattatctttcaagacacacatcagtgtcacctcttcccaaaagatttctcttgcctttctagtagggtttaagtgtgccttcctctgtcctccactagggtcctgcctgtacagcagttatagcatttgtaatattgcactgcagttactactttacatgtttactgtccccaagtgacagtaatcctgtttcagtgaggcagtgatactgtttcagtcatcattgtgtacccaacacccacttcagtgcctggcaccaagtagctgctgaatagatattggttgattgaacgaatggatacctgaataaaagaacaaggattctgtagctggttgacttacctaacatttggcagtcagtagaaagaattgttaaaaaaaatcaaaatctcaagtttctccgtgtagcaaggaagagatatttgccattgttattcatgggcagctctagaaaatggcagaatcacagacaaaaattggcaagctgccagacattaatctcagtgaatttctgaaagacattcatatgccctaaacaaattccttcaagctgtttctatgtactgtgtaggtctcataactcagaattgtatctcctcaagcacctaaaccattatgttgtagggacaatgagaaaaaaggatatgcaatagaactggggtaagccttttcacagcggctagaacacaaagcaaggatttcccaaataatctgtcctcaaacagctccttttattctcccagggacccaggcagctgactaacaagatagtatctgccatcccaaattaaggtctaaaagcagagcccagggaaagagggaagagagcattcttaggtaagcagcaggtgtgaacagcacaaaaaccaggatcagtgtaaaatttggctacaaatcaacaaataagcaccacatacaaaattatagatgtaaagatacatacgaacatattttccagaaagtagataaaaattttggaaaacaactattttgtatgctaaagaaaattaaagacattacatactctgtaataatcgagactcaaaaaaagagatcctaaaactctagataacagtaatataacacattct

SEQ ID NO: 7600 - DNA, 1108 bp, Homo sapiens
acctttgtaattatgacacaggggatacttaaacaggactttgcttgccaaacaaatataaacacaaaattgctttaagttgctaactgttcttcctgctgtggacattggccatgacccagcaacttggctgctatttcagccataagagattttctgtaggtcctcaaatactatctcaagtaaaaattcttatggagtccactcattccaggttagggtaagaaaacttttctcctaataatgtaataaaattttactttataaaatgaaaataagcaacattctttcatattataaagaacataacataaaaccaaataatcttttggctgagaggaaatgccaaacccatttcagaacatttatgttatttttccatgctctcttcaagccaagttgattgcatacaaatctcctaaggggatgtgcaactgattccatggtcctggctcagggcaaaaaaaatggaaccatgactgaggggttttataaaatatcctttgcccaggtaaatatggaggtgtgagttcacagagacagtcaggtagacagatgtcaggttaggaactccaggctccaaggtgctgatgaccagcagtacctaattacagctcctctagtgtgcacctctctgagtactgtgtgcacgcttgccagcctagaggtgtcttcagtggccatcggggtcctccaacctggagtagcctgtaggcagcatggtgggaagtccctgagaggagaaacattcttaggtgctgtcctgtgctttctggcagttgtttcccttgagacacagccccttttgatccctttatggatccctgtgagtcagaatttggaatgtttcagcctcctaatttaaagcatgttttctttaaattacatttaacttctctacattttataatttttaataataattatccaagtaatatatgcaccgtgttaaaacacacacacacacacgcacacacacacacacacattaccaaaggagagagagaaacagagattgagagagagagagagaaagctttaatttagaatggacctgtgggtccactcccagaggcaaccatttttatttacccttttctagttttag

SEQ ID NO: 7601 - DNA, 1145 bp, Homo sapiens
aagaatttatatccttataaagctataagccagtggcaagaaattctgtgtaatttagagaaagattcattcttcttaaggcaacacttggctatttcaatttcagaattatattatatataaagttgaataattttatttttaaagcagtttgtacaaatctttacattccaccagaggaataagcttctttaatggcatattagacagtttaggaactatattaaacctttaaagctctgaggtcacatgttactaggttcatttcctgataccaagcctcagttgtgagcttcaagccttacggagcagcttactcacactgatgagcattttgaatttaggccacacacacacaaaaaaggcccacagatctaagctcctgacaaaatataacagtctacctacatcccaggcaaaagtttctgagagacccatagctaataaggttataactttgttctgtgttgctcttcattcaaggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgtgagtccagcatttcttcatttttgtggtggggggcatcttggttagcaaggaaacagattacttacacattatcttgaggacaaagtgtaaaattcctgtcaatgtacatgta

SEQ ID NO: 7602 - DNA, 3214 bp, Homo sapiens
agtattctatgcagcttctcacatcataatatctccatctgtgagccctttgaaagcagggggagtgtcctacttatgggcttagtatccccagcatctattaccatgcctggcacttgtttggtgcacattaaaaatgtatgaatgggccaggcacagtgactcacgcctgtaatcccaccactttgggaggccgaggcaggcagatcacaaggtcaggagttcgagcccagcctggccaacatggtgacaccctgtctctactaaaaatacaaaaattagccaggtgtggcggcgggcacctgtaatcccagctacttgggaggctgaggcaggagaattgcttgaacccaggaggcggaggttgcagtgagccaagatcgcgccactgcactccagcctgggtgacagagcaagactctgtctcaaaaaaaaaaaaaaaagaaaaaaaatgtatgaatgaaagccaaattatttttttgttttttcttcctgcagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaactccaaccttgtcttatttaacttgggggaaggggattctccaatgtcttttccaggataaagaaggaaattaaaataccatgaaaaaatggacatggcagtagaaaggaaacattctgatcagaccttgggaaaagctggtgccgagagagggagaggccaggtgtccccccacccaactggcactgattctcagccccttcctcttacttctgttggcttcaaggagacctgcccttgatgtgtgttgctgctgaagcaccctcccagccagtgagttggacatatgcagcaggcactttgatgtccaggaagtacactggtacatgacaggagcaagggtcagggaggggaggggaaaggtttctacaatgcagatgttttcaaaattctccaacaatcatgactctaaatggtatgatttagggctgggtgcagtgactcacacctgtaatctcagcactt

SEQ ID NO: 7603 - DNA, 1160 bp, Homo sapiens
aaatcctttttaaaggcactttgacatccattatctcatttaagtctaaaacacgaatttcgacctccgcgctgctttctggttccacctggcggcagctgcacaaagtgtttctcttcgaacgccgtcccaagttttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatctatatctgcatcctaccttttgctgtgacttatcttctcaagcacttgcatctctcctctctctcctgccggattgctgtcactttaagcgacataaaatacacaaggagtagttgtgtcatttactgaatattttatgccagtggtttacatttatgccagtggtttacattttacataaacagcagtttatggcaagtatgatgggctgcatctaccaaaaatgagttcacacgccgagtgggaagtcaggaacccttgactccctataccagtgaccacatatttctccctta

SEQ ID NO: 7604 - DNA, 1339 bp, Homo sapiens
ggaccagatggctaaagggaggtacagatgaagctcctgacgtctcagtgtctgaaacttggccactatattagcagtctatgtaaccattaaaatattccaggtagctctgcagattaaattacagggagaaagtgtagaggctgaaaaaaaaggccgtagagtgaaggtctggaataggctagtagtggagagtaacaggcaaaaggagaccttgtaaaggaagaataaaccctatttggtgatgattagagggagaagttggcgatcacaccacagtttcagttccctggagaattctggtcccatcgatgcaccggactaaacttggagctaatgagttcagttaggtgttcattgacattgaagagatcatcaaaagcatttcaaaagtagtcagaggttgttgggagccctaggattatataacacatggacgattctctctttcacaggaactgtcgacaaacactcagtggaggtcaccaattgcttttcagtgccgcacaatgagtcagaagatgaagtgagtgggaatccaagctgtccctctgcagtttttagctgttcatttgctcggctcccctcacggtccctcccacactcataactagagctcctgtagccaaggagcttcttcccatttgtacgtacttcctgggcctcttctgtttattgggggtggcctcttgtcctttttaaccaatttttctttggacttctggcttcttagcttgctttcctgccttccctcttaggtggctgttgacatggaatttgctaagaatatgtatgaactgcataaaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgcgaccctgtctctaaaaaacaaaaggaaagtgtgttacctgtaggaactgtgaattcagtgggttttgctggtggttctgatcctgtggggccaggatat

SEQ ID NO: 7605 - DNA, 2298 bp, Homo sapiens
cctctcccaaggccatctgtttactttggcttctccttccgcagcactttaatgggagtccctgggaggaccatgggagtgatgttcacgcctctgacagtgaaatacgcgtactacgacactgaacgcatcggaggtgagtaacctttccatacactcgcgagaggccataggcattttcagggaagggggctgctagtctgcaacatggacggaggccttgggtggtttgaaaagggactattgatctaaggtttgtgaagactagaagtcacagtcatctcttgtataaatgggatttaaggagttatttgagaaactgttaaaggtgggaaatgatcagcaccagaggccacataccattcacatgagatcaaaaccggtgatgagcataccaggtaaaaggagttgagctctattaggaggaagaaaagctgataagggcacagcaggaagtgtgactgagcagactgagtctaaggggagttgggaaacagagttagtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttcccccatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggcc

SEQ ID NO: 7606 - DNA, 1163 bp, Homo sapiens
acatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcct

SEQ ID NO: 7607 - DNA, 1969 bp, Homo sapiens
tggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctg

SEQ ID NO: 7608 - DNA, 1103 bp, Homo sapiens
agaatcatagcatgtttctgtttaaagagaaattgagaccaaagaggttaagtggcttgcgtaaaaccacacagtgattaataccggtgccctaattagagctctcacgtgttttcactaccctggatcagatcacagttataatccagtcttcctaatccttcctctcccactgacagggttagggctacaaggaggagagggagtggaggttggaagggataacactgaacattctctcttgtcctctctggcccacaggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagagcctcatgtgttccttggctttgttatctagttctctctcctgggaatgggctgggactggcc

SEQ ID NO: 7609 - DNA, 1320 bp, Homo sapiens
ttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctatgtcctctttggaatgtaacaataaaaataatttttgaaacatccatcagtgtatctatctatgtctcctagttttttcctcctccctcttttgctgtataatgagattgaagatataaagacattttgtaccctgttctgagactactgttttataccaatctaaccgtaaaatattggtgtaaattatgtgtttgcatgtatagacagaatatatgaatttgggggtggatctctgaaaagtatactaatattttgataaattgggagatttcaaattcctgaaggagtacttgttctgagaaattcttggcccaaaaaaatcagaattaaattcataaaagtgaggttttaggagccattaatgggattttggggtttagtaaaattttaagcacctacaaatatataa

SEQ ID NO: 7610 - DNA, 1180 bp, Homo sapiens
atctcttatgtcagtgccagcacatgctgagtgttatgtgaggttagtgcttattattattcctggtggtggtagctgtgggaggagagaagctctgggagacaccagtggtggggctgactaggcagggcgagggaggcaggggaggaggaggcttggaggctcatgacagggctgatttgggtcaggtttgtttggtgtcctggagctgaaagacctctttgccagtccctgtttgggaaaggggggtgtggggggctgtcagcttctccagcttcagacttagttcatggtttcccccttggccttgcactaacgctctctcttccttttcctttgcccctctgacctgcctggactgctcccgctctgccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcaca

SEQ ID NO: 7611 - DNA, 1174 bp, Homo sapiens
atgaaatcactggccaggagtcataaagattgctgtgttcttatcctttccttaactacatatttttttttttttgagacggagtctcgctctgttgcccaggctggagtgcagtggcgcgatctcagcttgctgcaagctacgcttccttggttgacgccattctcctgcttcagcctcctgagtagctgggaccacaggcgcccgccaccacacctggctaatttttttgtatttttaatagagacggggtttcaccgtgttagccaggatggtctcgatctcctgaccttgtgatccgcccaactaggcctcccagagtgctgggattacaggtgtgagctaccacacctggcctttcttaactaaatttttaaagcatgcactcccttgtaacctgacctacatgggtataaatatattctgtgtccttggggctaattcatcctgtccttcccagcccaacagatgtactgtgcaggctgtcagaaccctctccggttgtatgtaatcctgctcactgtggttatttaatcctgttgactgcttccttgtagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggtaatgtatgtcttgcctctcattgctgagcaaattgtcttcctgttttcagttactagctttcccacactctttttgtccagctgactggctttgaagaatggtgcacagtgccctggagtgagatttgaaataaacaattaaataaatgtgatccaaactattttccttaaagataggctttataaatctgtgtgtttgtcagacttttaaaaagaggcatctttcttcctgggggtagagctgaaggccaacctgataggtcctgtttggcagctggccctagtctagagatagaccagaaagagagaagttggagctcaggaagtaccagtcatacactaaaggttcttcactaatcatatattcacagtggaaaaaaagtctgtcattaacatttcttttgtatgcagatggtttaactaaacatttgagagaaggcctcaggaagttgagtaagtttg

SEQ ID NO: 7612 - DNA, 1215 bp, Homo sapiens
gttttctagtctggcaggtggggacaggcattattcccagccctgtgtgagcattttgtattgtttctcctaatcctttccggtgattctttctccagccttgagtagtttctttacttgcgtgaactgacccattaccctgctgaatgccctgcagatcccctggattctctctcttctctggtactgttcatatgaactctagccaccttggtctccttaactcagggagtccaccagtctctgcctagaactcccctccctgtgccacagcctggaagctttctctaagcagttagctgggatagttctaggggttacctcatttgttacctgtttctcagggtcctgcccttcattgcctgatgtccagtattctgaagtttatcattttatattattttgcatgggttttttcctattaggcaggaaaatcagtcccttttactctatcttggctggaaatggaagagtagctagattcttaaagaatgtttgacttgatttatttgtgtgtgtatttatgtgtgtgtgtgtgtgtgtgtgtgtgtgtattctcatccagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtgagtcaaccccagggattcactaatccaactccctagctgtaatagggtcatctagtatctgggctagggctgttacccctagaagaccttgtacttttctaaagcagatatggagaagacccagactatctaggtggtttgcttatttgaacaagaaagtatgtgacagaatatctttcagttctgcctccactatgcagattgggatagctccatatgtctaggacctgcaaaaagctgcagatgggttaaaatcatctcatgcctggatcccattcaacagcaagctagcattgtatttaataaatggcagttgaaataatcagaacctgaactgaaaagtaggtaagttagcagaattactcattagttacttttgaagatgactgtatcaaagcccagatagagttaagtgaatatagttttagatctatatgtcaagtgtttgtagatgtttcaagagagacatgttccatgaggaggtgtctctctcatg

SEQ ID NO: 7613 - DNA, 1246 bp, Homo sapiens
cgcccactcttctcgcacctcctcagccctccctaaaggagtctcaatcccgggggagtggcagttgcgggcgaccaagcagtcaccggctgcgctgcggcgacctcccgggaagctgcggccggcggggtccgaagagcatcacgtcatcctttcccccaggagcccgccccctcccagacggcgcctgcgcaggcgcggtaggaggagggtcacggtgggggctgtccacgcgctctccgcccttctccaggctcgctcgggccgcggcgctctcggctagctgcagcggcggcggcgcggaggggaaggcatccaggatgcggtgcggggcggcccggtgcccccccgccccgtcacggcagccgcggcggccgaggggaccgggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcgggtgagtgcgcgccgagcccggggcgctttcccgcgcccgctgtcgtcggggaccccagaagaaaccttccttcagccccgctttgtcccgggagccgggcgagtgtcggccgggaggaccagggcgggcgcgggcgaagggggctttggactggaggggggaaacggatgaggggctctgagccatgaggggtccaaacctacggcccgctgcgcagtggccacgtcttcggcgaccagaaagagggagggttgtgtgttctcagtttggtgtaggttgagtgacttcgtttaaaataaaggaaagcttgtcctctggcacccattagggagggaaggcgtcccacgtcctagtgaaagtaagttccacccagacttaaaaaaaaggaaaacaaaaacttggtgagtttatctggccacttcccaagaagcttgtgatactagttcctcaaaaccgttataccccagccctgggctgggccccctgagtcagattgcagctctgcgcgtctggatgggatatgaagtaataaagtgaacttgggcggcaccaagaagagtaggaactcccttagccttggaaagggcttgtatcccggggccatgccttttt

SEQ ID NO: 7614 - DNA, 1268 bp, Homo sapiens
gataattttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccgtgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgt

SEQ ID NO: 7615 - DNA, 1100 bp, Homo sapiens
ttgcagtgagccgagatcacgccactgcactctcgccttgggggcgacagtaagactgtctcaaaaaaaaaaaaaaaattagcggggtgtggtcatgtgcacctgtatgtagtctcagctacccgggaggctgaggcaggagaatcgcttgaacctggggaggcggaggttgcagtgagccaagattgcgtcactgcactccagcctgggcgacagagtgagactctgtctcaaaaattaaagaaaaaagaatgctagttgggataaatgggaagtgcagtgctatacaggctaatgaaaacatccaaaaagttttagaatttaagtcatcaaattccttaaagttcaatataagggagtgatgagaaataagactggaaccagttatgaagagccttttgtgcaagccaagcaatggaaatgtattggagcctctttgatctgtaattttaaagtatatttatttgcagaagtttaaaatggactttttttctttgtaggcacacaagtctctgaattttgtctcaacactgctccagattactatgtcggaacagctggatttacctgtgagacaggcaggcaagtttcctaaattatattgagtgtatgtaatctattgtttaaaaggttcataatcgaatagcagaagtgtcttgggatggccctttggcaattttttccccccaggtaatttgtttaccttcagtgtttacagctaacatcaggtaccttgatatctggtggcagagtttaaaggaataatttgacatttagttgaattaaaatagaagcttcaaatagaaattgatggggtttattaaaaggttctatgtatttttagagtccttccctgatgggtgattataagactcaaacatgtttgtttatatagtcatctcttaccacctttttgcttttatcgttttaacagtttaaaaagtattatactatttttagttcctgttcaacatattgagccacttccctcagtatcaaatagtctgaaaatgtggcatactacttttctgaatattatgttagtctgtaaaaaataatgtagtgtacatttttaattttttttattttttgtaggcagt

SEQ ID NO: 7616 - DNA, 1121 bp, Homo sapiens
ttcatataaaacttgtgggccgggcacagtggcctcagcccccggagtagctgggattacaggtgtgcacgaccaggcccagctaatttttgtgtttttagtagagatggggtttcaccatgttggccaggatggtcttgatcccttgaccttgtgatcttcccgcctgggcctcccaaagtgttgggattacaggtgtgagccaccgcacccagcctaattgatgttctcaaatgaaacttgtttattgatgataggaatgaaaaataaaacacctgtatttgtaacatttgctggttttcgtttgctcagtgacttattctgaatcatatatattctgtgtacatctaaaatcactgggttattttgaaattagattttgtctaaacagctattttcctttctatgggttagcaaaatcttacctagttaggattttttccttactgtttttttttggcttccagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtaagtgtttctttcaactcctatagagctttgagaagtaggaaaagttgggaaaatttaagccaatttgaacatgtaaaattatatttagcatagataataaaattagtgaattatatggtaatttcaatttattattttctttttgacatagcattctaactccgcagttgcttttctttattctactaagaaactccttgcacccttttttcttaatcaccgtctctttacctattcaaaaactaagttgtctctaaagacggcctcctcaatgtgtgctgataaaagtccttcaggtaagtttttctaaaatgtgaaggtgatcagaatacattgaggattaaagctctttattacttgtggcttttttttctgtgaatttttatcttaatttaggctcttgattaacttcctctgattctttaagaagaattcattggaatttcatgtgatcttctttaatcagtgtgttttgggggattcacactcacc

SEQ ID NO: 7617 - DNA, 1133 bp, Homo sapiens
atgtttggctttaagcttgtagaattattttaaaaagcatgtcttttataaccaactagtgaagcagtgaggatgcctctttgatttaaatagggttaatacttttccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcgggagaattgtgtgaactcgggaggcggagcttgcagtgagctgagatggcaatagagcaagactccatctcaaaaaaaaaaaggccagcattagtgaagcattcacatttttgtcaatctattctcatctcatgctgttcctcctatattgtattatctctatcattaaataagtgtctttttaaaggaaacacttcaagttgaagaagatgatcgacctgagttaccatggtggaaatgcaagaagtgggccttacatattttagcaagactttttgaaaggtaatctcatccatatatggtgatttaaattaatttattaaggttttgctttaaagtgctagcataaagcattataaagaaacaatgggcattttgatgttcttttagatatggaagccctggcaatgtttccaaggagtataatgaatttgctgaagtatttctgaaggcatttgctgttggtgtccagcaagtaagtctgtttttagtttttctcagtggaaacatggcatctttaagttaatttatatattgcttattcccagtttctttgacatctaaagagtgcctgtttggaccctgtaccaggtctcaaacatttttggtctcaggatctctttatgttcaaattacttaggataccattgggttctcatttatgtgagttatacctagtaatatttatcatattagaaattagagtaaacagttcattaaaatataataacaggcctattatatgttaagacaataatttttttttctcttgttgcccaggttggagtgcagtggcgtaatctcggctc

SEQ ID NO: 7618 - DNA, 1402 bp, Homo sapiens
tgagagcaagggtatgttttaaagctgcattatttatatacttttgtcttgtaatgaatgactctgtggacttttatattgaaacttttaaatgttcactttgaagcctgtgtcttattttaggtttctgtttaatgtaaatctttacatggctgctgtaatgtgtgcataggtttcatctgtgtctggtagcagtgtctgtctgtgtttttcattcagatcttgctatccacacaaacatcatgcggccaaagagtaacttgggatcatagtactggtctagtgttgtctctggacacatctaccactggccagcctccaaattcccacacacagaactcagggaatagagattagcttgggggaatttaaggtaaggtatctacagtaactcactgtgtttttacaaaaggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaaggtaaaggatttttgtatgtcaagaaaagtgaatgttggccaggtgcggtaggtcacacctgtaatcttagcacttcggtaggcttaggtgggaagagcgcttgaagccaggtgttcaagaccagcctgggcaacatctctacaaaaaaaatttttaaaaattaactggacatagtggcatgtacctgtagtgccagctacttgggagtctgaggcagcaggatcactagagcccgacggttcgaggctgcagtgtgctacgattgccactaccctccagcctgggcaacagatcaaaaccctgcctcttataaaatatatatatatatattaattgtaaaaagccataatcctagaaacttggcatacttcctttttatgtgaaagtacttttttaaaaaactcatcgatatttgttatatcaggttttaagaagttttaggggttttacgcaagttttttactctttctcttacagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggtatgttgtttgaacctaccatatttgcaagcattttaatgtagctctcagtatgttccaggttgtgtcaccagtggcttgccttaccttatagcagtcaacctttttggcacctgggatcggtttcatggaagataatttttccacagatggtccgggggagatggctttgggatgaaactgttc

SEQ ID NO: 7619 - DNA, 1402 bp, Homo sapiens; identical to SEQ ID NO: 7618

SEQ ID NO: 7620 - DNA, 1503 bp, Homo sapiens
agagtctcgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggtaagtgatgtattgcaattttactacatttgctttgggaggaactctgcttatttaagaaaagaaaacagttttttttttttttttttttttttttttttttaggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccggtaagggattttcaatggaagaagacaaaacttatctacttagaaatattaccgcactgggccgggcgcagtggctcaggcctgtaatcccagcactttgggaggctgaggcaggtggatcacacggtcaggagttcgagaccagcctggccagtatggtgaaaccccacctctactaaaaatacaaaaattagctgggtgtagtggtgggcacttgtagtcccagctacttgggaggctgaggcaggagaatcgcttgaacccatgaggcggaggttgcagtgagccaagattgcatcactgcactccagcctgggtaacagaacgagactccatctcagattaaaaaaaaatatatatatatatcactagcccttctcccaaataaatgtgggatcatacccaaatgctttcattcacagaaaagacttcctttcttctcactagagtgatgtaatcaggaacttcagctgtattaccaacatgtagaacagttca

SEQ ID NO: 7621 - DNA, 1045 bp, Homo sapiens
tataagactgtacactatcagtgtataaattgataaaatattaagagaaattattataagggtttcaacataagatagctattgctatttttgtcttttatcatttactaacttagccagccttttaaaaaaaatcttacaaaaggtttggtgggtgtaacggtagtgtgttcatactgcgcagttctttttcagatgtctagtattaagaacacattaaatcaaggttggttttcttggactcctatggaaattttcatttctattcattattgaacatgtatttaaacaccaattcctggagctctctcttgtcacttgtgacttgtaatttactgacagtgattgagatgattgtcaatttgttgagtaacaaaatatgtcattgttataaaagtacttatattatgacttggcagaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaagtaagtcaacttgttacatgtggatccatttcattgaacaaatctgttgtagtttctgcctgccctttaaaggaagagtttggaggatatcaaacccagactagaaaaggctggttaggcaaagtaaccaaaattatttctaaggttgccatagtttctgagtattctttattcatcctgttattttacatttagattgtaattttggaagattataggaaaataatgtagttcaaaaaagtatacagtgacagtgcctctttgctacttctgattcccaatctcccagctttcctcagaagtaaccactcttacgtgtatacctgtttgttgtatgttattatttgtgtgtatccttttttcctgcccaaacctatacttaacgtgttaagagtatattagcatttatggcatatgat

SEQ ID NO: 7622 - DNA, 2079 bp, Homo sapiens
tattctctacataatgcatgctcccttgcccttatacattggagaaatcatggattttggaacttcctggccactaatgatggttaagctactggcttgtttaatgttttgtcagtttctcaccaagttagtagatgattgaatgccctactaaaattttatttgttttctagaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtggggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagg

SEQ ID NO: 7623 - DNA, 1122 bp, Homo sapiens
tgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatg

SEQ ID NO: 7624 - DNA, 2256 bp, Homo sapiens
ttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagaccaacgagacttaggtaaggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggtaaagttgggtgtatctatgtgtattttcatataatgagatggactttggtttagggacatttcctgaaaacactgggtttggag

SEQ ID NO: 7625 - DNA, 1201 bp, Homo sapiens
tgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatctggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccactttgttccttcattctcctaatgtcatcactgccctttgctcaagaagtaactagggatactggacatgttagcatgagcttctgggttccagacacacttctgcagagtttaggtaagagacttgaggccaagattctcatatgtgctgccactcctaccactgtctctaataagctgtttgaaattgcttaagtcccttacctattctgggtccattccaccacccagagtatatggtaatttgtgaaaattttaggcatgagacattgaagtctgtttgagcagcagatttttctgcttcagggaacttttttttttttttttttt

SEQ ID NO: 7626 - DNA, 1229 bp, Homo sapiens
atagttcaacagaggccttttaaagaattctacataatatttttattttctaagtttattcaacagaagtctgcaatatcagtgaatggggctcttttcaaaaaagactacagatcagtggatgagttagctattttcaccatctagggattttcttctcaatccctgaagaattcagaagttgaaactaagttccatatttgaaatatgttggccaggcacaatggctcacgcccataatcccagcactttgggaggctgaggaaggaggatcgcttgagcccaaaaatttgaaaccagcctgtacaacaaagtgagaccctgtctctacaaaaataaaaataaaattaaaaaagaaaataaatatatcttacccttcaactaatatgtttctgaatcttagaaaattactatgatattagtattcaatttcttatattctctgtctccctcttctctcatttcctttccccttttcttcccctctgttccttcccccaatcattctcttctctattctatgtctctgaagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccggtaagcatctctctataacacaattaccacccgttcacataaggacagtgctaaaaataaaggaagtaaaatctgggaatggtgccttttcatcaagtcttgtctcacacacaaacttttccactttgctacatgcaacatgtacagcttaaacaagaactatacttgatagtgtgaggctccacattgaatttgacatcttaatatgtctggtctgtacttggattttaatagaaattaatataataaagtctttggtcctaggcaattttcattccagcaaaccagagtattcacagatggaaactaggttataccaatcttttttctttctcctgggaagcatccaaatacatttaacagcttcagaggtaagatgagcttctgtgccatgtgatatgagatatccatcctcactcttacaagtcatacgcacacacaagacagcaaactaatgactgcaaatgctgcttcaggatctttcaagcaaagaggttttt

SEQ ID NO: 7627 - DNA, 1407 bp, Homo sapiens
ttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtc

SEQ ID NO: 7628 - DNA, 1897 bp, Homo sapiens
gtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaac

SEQ ID NO: 7629 - DNA, 1218 bp, Homo sapiens
gtgttgtcccaaatctggataatataccactgttcgttaacttaatatacaaattgttggtagggatatccttgtttcatattctaaaactgtgtagtaccacctaaaactttttggatggatttctgtttatatcatgaactattttaatttacaaatcttaatttataggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtgatgtgtggctgtaaatggcatccatagtctgggagaattgtcagctttgtttttgaggtataggagacccaccttagtttgacttaaggacttcccaatttttgtttttctgctgtacaagcctgggttccagaaggaatttttagactcttcaagatgagacacaagatttaaggtgtttatttcctttgagttactgaaactaaccaata

SEQ ID NO: 7630 - DNA, 1336 bp, Homo sapiens
actttctgaaattggacaacccaataaacaagatgtttgtgtgtatgtgtatgtccataccgtctatcttagtgtagttttatggctagttacaaagacatttgagcctaatgttcattttattcagtctccaaaacaatagagtccttcagaaactatatcatcacacatgttataacataactgtgtattgtgttgtattgatgcaatataatgatgatgatgaatgagcatgtcactaaaattaatatataataaaactctgacttactatgtaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatgtatgtacttcaaaagaaaaacggtccttgaaacagcatcagtttttctctcagtttatttaaattttcagttaagtgttaggtacttagttctaagatcatttgtaactttctggattataagattattgacgcagttgtaatgaacactgttcttagacctgtgcagtaaattagatggtaattatatcagaactctgagataagaagtaaaaaaaaatagtattcaatgttaggaaggaattatgatataattactaagtaaaaaattagggaatat

SEQ ID NO: 7631 - DNA, 1318 bp, Homo sapiens
atagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatc

SEQ ID NO: 7632 - DNA, 1194 bp, Homo sapiens
tttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctcttctgtagttcttggatttcttttcccttttgactttgaataaatgtaaaatcctttcagccagaaaaagtaaaatagaaacaacctgtattaaaaatcttccatagaagcaaatttgccacccaactgaagcacacctctttcagcatcaaaatattttagaaatcttaactatttttggatgggaatttgtcttaaagagtgtaaatgcttcacggccttctgaaaggacaaatggaatatgtatgactctttttttaggggagccttctttaatcaaatgcagttctgggccataagacagtaagatcctcaaggaccataatattagagctactatattgaagtcagctgcgtggcaagtgccagattaggcagtctacctatattcattcatttaatcttcactgaactccatgagcattttcttcatttcacagatgaacaaatggaggtgcaaagagattgacagagtagaagtcagacaaaaacagcatctagtacagtatgtccaggttatagtgattattttaagatcaaatagggagctgttttctattcaatgtcagaaaccatcaggaccaccctacattctggttactcaacagatatctactgagagcctcctcagaatcaggtgctgtggtacgctttggggtgccaagctgacccagatagggtccctaccttgaaggcatcccagtctaatgagggagacacagccagagcaagcaatgacaaaacaaagacagtcaacccgatgtgggaacagaggtgttacggaagcctcagt

SEQ ID NO: 7633 - DNA, 1210 bp, Homo sapiens
tggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcgttctccttctcacccaaaccatgatctcagatcttaggagttacaggtcagacatgtcacggagcctgtttgagatcagttgtctacgttggtgatgaaattataacaccctaaaagaagactttggagtaggaacttgccagggtcatcagacatggttgggttgagagaggaaatgcgattatacaaaaaacgtagaatacaaagtagtgcttattctgtgatcatggctactgtttcaggggacaggactagaagggaacccggacaaagaaaaacccttggcctgtgcaggctgtggggttgtgagtgctgtttccccaaattaaaatatctttattattgtcatgattttgttgtgccattgaggtacattaacttaaataaatcaaagcgaacaattttaagatgacgagtaagtctggagaaaaacctaggaccccagaaagaaggcatattgtacatcccagtctgctgtaacttccggagctgctgctgatgacaaagggctttaaggcaagggaagtgtttgcagcactttgggggctctatgcctgtctgcatgcttgtttagtttttgccatggcctgttcaccagcctgtctgccctgaaactgggaaaggtggatccagctgctgtccaggccttcaagaagcagagccccattcaattgtccacttctctgttgctgcccagagccagatcctgtgtgggatacttggcttttca

SEQ ID NO: 7634 - DNA, 1630 bp, Homo sapiens
cttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgcagaagtgtatgttgttaggaatgaaatgtgctttatgtattgtgagtgatgatatgaaagacagagtaaaggaggtcacagctttcatctttttgaaggtgtccaccaagcttgataattggaactttaggtgttacatctaacagcgtttcttaaacaatacccacaagtcaatcaatccacttgcctatctcactctttagtgcatcattaaaattgacataagttttgcagaatggcttgtctgtcgatcccagacttaccctgagaagccaggtcccatgggctttagcacaccagcccaaccattgagtgttttttgttgctgttatcccaacttgttgggcacatgccaggaatgagggatagagcagaggatggggtacagagataaatgcagcatggctgtttcctacacagtacttaaattctcaggagtgggattgcacattgagctataactcctcccgacccctgtcctcagcatcaccatggggttcatgattcaggtgtatgcagcacaggtgccta

SEQ ID NO: 7635 - DNA, 1152 bp, Homo sapiens
ccagagatctctaaacagaaccaataggagactgtgtgtgtgtgtacatgtagttgtcccttggtatacacagtgggttggttccaagactcccctcataaaccaaaatcctcatgagttttggggaattgtttctaaatgcaattctactgtaaaaatacacaggagatagcctgaaagagttctcaatggccaaagctggaacaacttgaacaacaaaataatgatggtattctattataaaccaaagaataaaaaatatacacaagagcccgtattgatataaataaatgataaatatataggtaagtgcaggaaaagcagaaaattttctgtacagaagaattttaaacgtatttgtagatatttgttcctccaggaggtagtgcttaatttcccccaccttaagtgtggattgaactgagtgacttccttctaaagaagagaatatgggagaaaaaaaaatagtaactttccagtgaaaaaaactggcagatattactcgaaacaagtagataaggttaacatcatcagtgataattcatgttgatagcatgtactccctgatatgatgtgatgttatgaaaaaggcacttcacctttgtggtaattttccccaaaactcataactctaatataatcatgagaaaaacatcagaaaaaacaaatctgaaagatattctacaaaatatctgcccagagaactcctcaaaactgtcaaagccatgaaaaacaaggagagattgagaaaccatcaaagattagaagagattaaggaaacatatcgactaaatgcaatgtaggattttgaataggatcctcaaacagaaaaaggacattagtgaaacaactgacaaaatctgaataaagtccatagttacttgtattgcagcaatgttaatttcttagttttaacaactgcaccatgattgtataagatgtggacattaggggaagctgggtgaaaggtatatggaaactttatagactatctttacaactttttagtaaatctaaaattatttcaaaagtaatataaaaatgtttgagcaagttcagaaaagcaaattctggcagtgactagtataagaaaagtattattttgtaggtcaggaatatttccgcaggcctctgcatgagttgtctgaaaaa

SEQ ID NO: 7636 - DNA, 2014 bp, Homo sapiens
aaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtca

SEQ ID NO: 7637 - DNA, 1113 bp, Homo sapiens
cttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagatgatgtttgattactcattgtgttaattaagtggtttcttaagggaacaagtgttagtgaaacttactttagtagctctgttccttttctccagtgccttagggtttgaatctagaagtcagcattggtcattcagcaggtggaggggatgtgaaacagtttgatgttctttgacttgttgaatatttacttaagtccgtgtttcttaaactttttctatgaagtgctcctgatatagaaacccaactgtagaggaaggtgaatacctacacagataccccatgaagatgaaactgaaaacagctaaagccacacacacatttatttgaagaccagtaaaaataatataattgt

SEQ ID NO: 7638 - DNA, 1188 bp, Homo sapiens
aattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtc

SEQ ID NO: 7639 - DNA, 1192 bp, Homo sapiens
aaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttaggga

SEQ ID NO: 7640 - DNA, 1128 bp, Homo sapiens
agtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaag

SEQ ID NO: 7641 - DNA, 1317 bp, Homo sapiens
accctgagatcatcagaccaagaaatacagatcctgtttatttagaacactgctgtttgacatttataattttgattattctagcctttgagtttgaaagataatgacactatcattttagagtatacattactatgttgtgtacctctgaattaagtgtacagacttgagttcaagaactgtatttgccctttaccagctatatgaccatgaacaggttacttaactctctccaagcctcagtttctccatctgtaaattgagggctacaatagtacctacctccaagcattactataaagagcaagtgaggtaatagatgttaagtctgacaattaaccagtaactaaattctagctgttattttcttcctcctaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatggaatctctgctgctatttatgctatttttcccaggagagtttcaggggcctgtaagcactctgttgaccaaccaatctgactcacttagcacaaagacaacatgcctgggatggatccctagtgtcttgtaccctcagtttctagtgaagcatcccctattggaattagggccttgtgcatgtcaaagagaacaattcatatttattttcagagggtgccctggtctccagcctcagaagttacccatgtactcctccttcatgcaggtttgcctttacccatccctgcccttcctccatataagaagctcttcatgcaccccttagcctgctttagatggctcagagcctaaaatggggatcacagactggccaacctagaaaggtcatcaatgccattcaacccaacttttttattctgtgaggttcagagaaatgtcttgctcaaggtccagcaataggtttaacagagacattcacatacttcacaaatacttattgag

SEQ ID NO: 7642 - DNA, 1222 bp, Homo sapiens
ctgtgccttatgttacaagaagggcatgtttcatacgtgggatgtacctgcaaactgagatctagaataagaaaataatggagcgggcttgaatctgactcacagccttgagcagagacacagaagctgacctgcatccaccaacttgtaatacaacctgagaaatgaatatttatttttgtaagtcactaagattttgaggttgttatgtaccataaaaccatttcttttaccaatttttgtgttttggagctttgctgccgtcacaatgactcccgaagtcccagtggcttgaaacgacagacatttatttttcagtgatgggtttgcaggttggctgtggctctacttgtctctgtttgtttctctgtatgtcatttcagtctgtgattcaaattgaaggagcagctcctatctgggacatgctgttctccaaacagaggccaagaatacaacactatgcaggtgcattaatagttttcgtacagatatggcatttgttacatcttctcatattctgttagccaggttatatgtctaagcctggtgatgaggcaaagaaatgtatttcatctattgggaggcaaaagaagtcacatggcaaagggtgggaaaagataatttggaacataatacaacctaccacatgtgttaggcttctaagacatgttagattccttccctcttcagcacttatcttcccatttcaggattactgagcaagtataaaatatgaatacatctgggagaggtaaattagattaacttaatttcacccagggtagcaattaaatactgttcccagagcaggttccagctgagggttgcaacaaaaaagagtaaagaaatagttaaatattagaaagtggaaatgcaatttcatgaagctgtcagtttccaggattctaaaatgaagtgtctgtggcagtgacccttttcttttgactaattgcctaggttgatttttttttccctcttcagtgctctaggaatttttatgagcctctttaaagtaactgagatgccagtcaggatacttgcaatgaacagctgatatctggctgttgctcctgagtgaaaagtcctttttggccgctggagcttcttctttggattgggatctactgtattagggcatgaaagtttgtttaaaaagtgtttctatctattatataatctgccatagttccttctccctacatttatgcatgtaggtgtgggt

SEQ ID NO: 7643 - DNA, 1194 bp, Homo sapiens
gtgcctggtgccaaaaaggttggaaactgctgctttaaacttttaagttgctctgataaacttgataagcaaagaaaggcataaagaagagtcagtacatgaccattttatttagccatttgctgaacagaagtgcctagcttttttcactgtttttgttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcaggggaagaagacaagaaaattaatgaagaactggagtctcaatatcagcaaagtatggacagtaaattatcaggaagatatcggcgacattgtggacttggcttcagtgaggtagtaattaacttattttcattgggaagataattagttttcaatttggtaccatttattgctgttagattaccctagcaatcaagaatcccatgtagaaagctttctgtatgtagttatcttaaaaataattttgtatatgccctactggtcttgtagataatcaggagagatgtttctaaggattttgtgtggggttgttttttcctttttttttgagatgcagtctcactgtcaccaggctggagtgcagtggtgtgatgtcttccacctcgcgggttcaagtgattcttctgcctcagcctcctgagtagctgggattacaggcgcctgccatcacgcccagccaatttttgtagagatggggtttcaccatgtaaccaggctggcctcaaactcctgacctcaggtgatcccacccaccttgggctcccaaagtgctggtattacaggtgtgagccaccatacccggccttttatttttcttttggagacagtctctctctgttgccccaggctggggtgcagtggctccatctcagctcactgcaacttccacctcccgggttcaagcaattctgcctcagcctcccgagtagctgggat

SEQ ID NO: 7644 - DNA, 1206 bp, Homo sapiens
atagctcgctacagccttgaactcctaggctcaagcaatcctcccacctcagcctcccgagtagctagaactacaggcatgcaccaccatgcctggctaatttttttcttttttctttttttttttttagtttctctctctctctctcccttttttttttttttttttttttttttttttttttttttaagagacagggtctcactatgttgcccaggctggtctcaaactttgggcctcaagcaatccccctgcctctcagcctcttgagtagctggaatcccagccacaggtatgagccactgggcccagccagacagagctctttcttaaaattctactcaagtcttaaagctgttgttctaatggctacaaagtagagtgtttctaagaccgacagaacttacggtctttctcagattttgtatgggctaatgtttatttttaaaagagcctgttgattgatgttttaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagct

SEQ ID NO: 7645 - DNA, 2257 bp, Homo sapiens
gcagccagcagggtggctgtcctctgcgtgcccagcccagctgttctgtgtctctcttgcctgcctcctcttcctcagagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttggaacttcagttgcctaatcctttccaacaatagttggaaaccatcacctaagagtgattacattgatttggagtcattgagagcttgtgcatgaatgggtgaaatgtgcgaatatggctctgggtttggggttctggagggacttgaggcatcaaagacaatcaggaccatttggggctttgaggtggatggatgggagagagaagatggcctgggatagataagcatctgctttggttttgctcaggggaagagaggctttgagcctgctctgttctcaacaacctgctcagcggtcaaaggcctgtgaggatgcaggtcctgggtcaacaggaagtcaccacggagctggacagtcatggttgga

SEQ ID NO: 7646 - DNA, 1211 bp, Homo sapiens
gctgtgagttatttatatgccaagaagcacagtggaggccttttcaccttctcatgactttaagaaatacaggaaaacagcattctctacaatccataatccctgagtgttggcaacaaaaaaatgaaagatattctaatgtaggcgtctgtgcaatggtgatgggttatggatggtcaatgagaaccttggctgccagtcctgggaactgatctcagccttccctgggaccctctggatgaggggatcctcattcacctaactgagcaaacatcccaaacatgctctgtttgcccatttattcattccattcattaatgtactcattgattccatttggttcacttcagctactgatcacctaatgttatatgccaggccgtgtgcatggctgtaattatagagctgtgactaagaccttccttccttcctgttcagtcagggttcagtagcagtagtgagaagttattctcgcttttctaaacagaaatggatttaatacagtgaactaggtgtttacatcatgattggaagggtgcaggagtaggctctaggctgacctttggcaatgataactaaaacaagactgtgaaaatggcccataagtaattgttttcattttccttttaattcaactcttttgagctccccttgccctttgctcccaacttctctgtcccagatcttaggctctctccttatgggaagagctgtttcaaagcatttatggattgtaaagtgtgaataagggtgttgttaataataactgtcacttgctgactgtttattgtgtgcccagctgtctgctaagtcctttacctgtgttatttcaatcctcacatctgttgggtagttaatattatctctacattgcagagaaggaacctgaagctaataaaagttaaatgacttgcctaggataattcagctaataagtaacatttgaattcagggagtgtctctgtccagaggtacttgcagtttaaaagacaagctgggccaaagaagatacacaaatgaccaataagcaaatgaaaagatgctcagcatcattagccatcaaggaaatgcaaaacaaaaccgtaatgaaatactactttacacaccctaggatgtttatattaaaaaggacagatactttagaagtgctggtgagggcgtagagaagtgggaacactgatgcactgctggtagaagtgtaaaatggtgga

SEQ ID NO: 7647 - DNA, 1248 bp, Homo sapiens
tggtttggagtgcacctgagtgttgcagaaggggagctgattggagggaggcaaagcaggggtgatggagtaggggctgttctctcctggacttagggtgctgtgaggcccaggactctctgacaggaggtgacttgtgcctacactgtgccttgtgaggggtgggccccaagaatggagggcctcatggcattaagcagagctgtttcctcccctcaccttcccctgtgtggcagagacacagcatgaccagcatcgcctagagctccccagccaaaggtcaatttgaatcacctagatttttgcttattttgctataagagaacagaagccaacttggggaaatcctgtgttgactgagtggtagggagtgtggattagctggggtctgccctaatggaatggtttctgcgctatcctagaggttgctggagaaattatattttaatgggaatgttcttttctaaactttaactagcaaagccacagaagcgtttgccagttaataatgtacttgatgagttgttgagctgaaatttaacagccagtttaaaaaataaggtagagaatttaaaaacaaaggacattgagagcatgtgtgtcttagaatgctttctgcatttctgttggaatcagtgattttgtgctgactgggagagtttcaagggccccgtatcttcggtggcctttccaggaggccctaaggcttggctccttgttcctgaaaagtaatttaatgtgtagcccatttgtagatgaaccatttcgccacttcatgaagccacaaggctggggcagctcttcttgctgtgagatagcccagtgaaggtggtggcagtagaaacggtggcctgaattcaggcaggctccaggtggacgacagcaataaaaccttcatggccagagcaggggtggggctgactgaaggaataaagcagggagtggagtttctgctctgatatctgagatgacaaagtcctgcagagtttgctctggaaaagagaaaaggttaaaaaaaaaaaaatccgaatggaaaatttaaggaaacggaacccaaggctccacttggattctgagtggtgtgtgttactgcagattggtaccttttgttagaggccctggatctcagttacgccccttctgcttaagctcccagttttacttgtgcaccctggctagtgactccagatgcccctgagccttgcttgctcttcccagtaccctagtgggcttctggttcacagtgtg

SEQ ID NO: 7648 - DNA, 1296 bp, Homo sapiens
tatccatgggttctctgacatggaacccatggatatggagagctgactgtgtatttgaaaaaatatacatgtccttaatttatgtttatctcatcagttttaatggctgcatacgatttcattatacagttgaattacgatttacttagccagtaatcgataaaattttttggagttgtcttccaaaagggagtatctttattgtggtagctgatcacaaaataaatacatgcttatgttgaatttttaaaaaagctagtctcaaaaggttgtatagtatattatttcattgataaaaaattcttgaaatgacaaaattatagtaatggagaacagatcagcggaagacttagaagagggtacatttctttgaagtggtggaactgtcctgtgtcctgattgtggtggggcacacatgaatgtatgcatgtgatgaaatctcatagaactgtacatatatacatagtatatataaaaacctggcttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaacctgtgaaatctctgtgaggtctgtagtttagttaatagtattaccatgtcagtttttctgtttttgacaattgcactattgtaatataacatgttatcactgagggaagctggctgatcggtacacaagaattctctgaacaagaagattagcatggcccctgcgcaaggatgacacgcaaatttgtgaagcgttccatattttgcgcagtctgtcaagatcatttcagtatctgctaattagcactaaggaactagtgtgaatctaagcaaaaacgggtggcacccaatgacgaaattgtggttttcattaccaaaaaaaaaaaaaaagaattctctgaacaattttttttttttttggagacagggtctccctttgtcacccaggctggag

SEQ ID NO: 7649 - DNA, 1119 bp, Homo sapiens
tgacctcagatgatccactgcctcggcctcccaaagtgctgggattacaggcgtgagccacaccacctgatcccacctcttaaaagggggaggggggtgcaaaatatctgtactcctggagcttgtagtctaattggaggtatgacacatcaaaagaaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacgtgattcccttttcaggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattggaaatagtaagtatcaactcttttgtcgttgttatcaagaatag

SEQ ID NO: 7650 - DNA, 1903 bp, Homo sapiens
ctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaatgttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctat

SEQ ID NO: 7651 - DNA, 1145 bp, Homo sapiens
aaactctgggctcaagcaatcctcccatgtcagcctcccaaaatgctgggattacatctttgcccattttttaactgagttgtttcttttggttgttgagtttttggagttctttatatattctggatattcatctcctgtcagctatctgaagtctcttataaagtttttcctctttttttttttcctctcgaagtcaatttgttgaagagattgtaagtttttatttcaacactgtgctttgctcacattgtgctcagtggtcatagcttatttttcacaaaacaggcttgtctgtttatagccttaaaaaggactgctgtttataggatactcccaaaggagcagaaccttaatgttgctgttgggtgatggatcctagtttcacacacctgagtgtagatcaaatatctagaatttcatatttgcatttgtatgaggttcagaacataggtacatgaattagattcagtgggcatgaaagtaaaaggccattccgctgaaatcatggctattaagaagctatcttgcagtcataaatatgtatttacttggcaattaggaatctttgaattcatcttggtgtcgtggaaagggcactacattaggtgttaggaaagctgagtcctggcattttctctgctgttaccttcctgcctgaggagacaaatcgcatcctctcttcagggcctcagttttctcatctactgaatgtgaggaatggatttgatgatcttcaaggttcttttctgctttgtctgggatctgagttgtcttttcaggttaatcatgaataaggtgtcattccactgatttgactctgaaggagtgtcctggaactttttgtaggaagttatgtgatattggaatttgctttgatggtcttagtctgtcctgaagactggatttgtgattggcttggtggtaatccctgggccagttacaggacctcttgaagcaattgagcttctccataacactcatattaactgagaaagaattgggaatttctcatagcagtgaggttcaaagagcaatctagtcttatcctgatgtgcatcttctctgctttctcttccattctgttgggaagcgagtggcatcgtgttccagtgggggactggtttggcatcatgtggacgacg

SEQ ID NO: 7652 - DNA, 1504 bp, Homo sapiens
ccacctaaagagataaatggaactgtgcaaaaatggaacaggcacctggggaaatggcgatccctatgtcactgggggtaggtgtttggcaggagttggatgaccacttggtggggtgttgttggatggagattggactagatcatgttgggaaactttgagcccttggtaaataaagtcttactggcacacagtcatgctcattcatttatgtatagtctagagctgcttttatgttacaatggcacagctgagtagtgtgacagaaactgtggcctgtaaaacatttactaactgtccctttacagaaaacatttactaactcttggactagatgaccttagaagtgcctcccagccctgagagttgttgtcatatggtattgtgatatggtattttaaaagatatatttttttcttttagggataaatgtagaggtattaatgggtggaaatattggggggagtggttgctttaaaccagtcagacccataatgaggaccgtactgcattgtatttggtataaattacataaaattttgtagatggatggttctgagatctaaatccttttctttattttgacagctccataaagagaaggttgtttgtattgctgctggactgaggcatgcagtagctgctacaggtgatcatcttatctttatttttttatttttatttttaatactttttagagatggggtctcactctgttgcccaggctggagtgcagtggctcgatcatagcttgctgtagccttgaactcctgagcccaagctgtctaactgcctcagcctcctgagtagctagaactataggtgcatgccaccatgccctgctaatttttaagattttttgtagagacagggtctcgctatgttgcccaggctggtcttgaatttctggcctcaagcaatcctcccgccttggccttccaaagtactgggattacaagtgtgagccactgtgcccagcctgccctccgccttttaaaataggtctgtaataagaggaaacttaactttaggagaaaaaccatttaggaaatatttcaaagggtcctgctgcattgtggttctgatgaaaaggagagaacataaggcagaagtcatgtaggaaagacattagcaggtagagaggaaggaaatgaagttttctagctctttgtgttctaggtatgatgctaggtgctatttatttgattactttatttaatcctcacaaccaggaagtgatgcgagttacattttacatgtgaagaaactgaggcacagagttaaagtgcttgtgtaagcttatacagggagtaacgtagagcttggatcagagcctgggatggtttggatcctaaggctcatattttttgcagggaactgcacagccttcctaatggattttattgtttattaatttaaaagctttaagtgagcttgtctcctgtactgtgagtgggtgatgggactgacagtctgtgtgtgagggggacagggaggtggcgtg

SEQ ID NO: 7653 - DNA, 1307 bp, Homo sapiens
tgaatcaggttgggtgttttcgttgttgttgctgtaagagttctctgatattctggatattaacctcttatcagatacatgatttgcaaatattttcttccattctgtaggttgccttttcactctgtgcattgtgtcttttaatgcacagaatcagtcaactttttgaatcctctgaaactctgtagtttttaagttttctgtgaagaatgaacaatgacaactaaatttgcttgtttcttttctttgggatttcagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaa

SEQ ID NO: 7654 - DNA, 1197 bp, Homo sapiens
ggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatct

SEQ ID NO: 7655 - DNA, 1443 bp, Homo sapiens
agctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgc

SEQ ID NO: 7656 - DNA, 1192 bp, Homo sapiens
gacccaagagaggactctttttctgtacaatctcttgcttgagtggcatggcttaggaaaagaaagtgtaggtcaaactcctgagccagatcctgcaatgtaatgctttccctgttgagtaagcctttataatatgcagcttaaaagccacatataatgaggtattcattccaaaggttggcaggtcatgagttagggttcttagatcccatctaggttacaaattgtctattttatgcctgggcctaaatcaaagccattctaaactattcaaacttttctcccctcccagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataatttttctctcctttattggactttaggaaagatccatgaaaccttagtaagcccaacttctcatttagcaaaaaaggcataaaatccatcttaagttgaaatttagtattattctacagcatataaagtgaattaacatggggatataccaaatagaaatctaaattttgaaatatttgaaattgaagcatttgagtaacttatctgtgaaaggtccaaggagatgctctcctaccaaccctactaaatttgtttcctttctaggcctcactgaaccataagtgttttcatcaaaaaggagcagagtggcaggtccaaactatatacctgataactttaggattaaagggaaagatagtgtaccattgcctccctgcttttattgtcatttaaagtttcgtcttcatggtgagtgattctgtagccaagtttgtgaccacccaatgaactatatagctgctgtatgtcctgcagagctcatccagaatagaatgttcttgatcaaaatgagagtgctagaaagctcatgaggctacaaggctacaaagaaaagtatattccaatttgggatgtta

SEQ ID NO: 7657 - DNA, 1151 bp, Homo sapiens
gttttaaggtaccagaagcccaggaactatctgatctaccccatctacccctggatttctgcaagatgttcaaaggacattgcatattatagattctccataaatgtttgtcaagctacacaggaaatatagtaagacatgttctctttttttttttcttggcagtcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtagttgagacttggtttctgacacttaacacttctagagtcttaaattaagatgtacataggacacaaattagttcacaattccaggaatgagttgagattatgattaataccagtaagcaagatttaatttggtttttcatcttacttagaaaatagaacatagaaagtcttaaatattaattacaactttacttagtaccctcaaaatattagactgatatgactgtaattactaatttcccttgttctacaggaaatgctaattcaactttagtatagtatttatacacccctgggcatggcaccttcctgctgaataacctcccttgggttcctgttgctcttggggtaaaagcaaaaattctcattgtgacctacaaagccttgaagca

SEQ ID NO: 7658 - DNA, 1125 bp, Homo sapiens
ggtggctcacgcctgtaatcctagcactttgggaggctgaggtgggcagatcacaaggccaggaattagagaccagcctggccaacatggtgaagcctcatctctactaaaaatacaaaaattagccaagcgtggtggcatgcacctgtaatcccagctacttgggaggctgaagcaggagaatttcttgaacccgggaggcggaggttgcagtgagccgagatcacgccactgcactccaggctgggtgacagaacgagactctgtcttgggaaaaaataaataaaaataaaataagataaattctttcactgagaacataatagaggcatgaacctagagtcagtaggaggatgccacggaagggatgaataactcgattaacattcacatttgtattcagagaggcattgcaggatgtcaaagggattgtaaaataggttagtctgggctcaaatcctggctctgccacttatttgtgaccttggacaggttactttacctttctgctcttcagttttctcctctgaaaagtggacacaataataacctctgccacatagaatgaagattgaatgagttaacgtgtgtaaaatgtttatgtcagtgcctggcatgtagtaggcactgtatgttagttggatttattaagctccttctctgcataaggcactctttcaaaagtgctcttgtaggtacttggcatacgtcattaaacaaaacatacccaaatccctactcttgtggagcctacagaaccgggacctgaacccatgtctgcttcttttccttttaatgtttattttccttcctctctccctcttaataattttctttaatgatcttttaaatttcaagttggctattgtcattacaaaggtgatggggtctacttcctgagccttctttgtgcttataaaattgaaaatactcttgctttactggatcgttggtctctgacaactggagagtcacggggaaggagactagcatggatttaaggattggatccttgggctgtgttgtgaaatagaaggtcactgtgggtgcacctttgcagtggaagacagagcttctaggtgggtgggtggtggacaggtgctacagctctcatctcttcaggaa

SEQ ID NO: 7659 - DNA, 1091 bp, Homo sapiens
ttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgacct

SEQ ID NO: 7660 - DNA, 1233 bp, Homo sapiens
atctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattc

SEQ ID NO: 7661 - DNA, 1100 bp, Homo sapiens
atgcaagtacgttgggaatactacaagatcacttttgaaataaggcacttggggagtatgccagctgtaaaattacattttatgctttatttctaaaagcagtttgagctgtgccagttcaaagcctctgaaagcagagttgacacttagaggagaaaagaatctcaagtagagaaattgtatgacttgagagaaacagactctatcaaagggaactctcttaaaagccttttgataaaatcagtgatattatttgacaaataaattcactttgacatttaaaggataattggttttaggtataaaatgggactcagaagtactaattccctttaaaagtgctggattcccttcctttcagatacaagtgtgtttgttttttcttaattggaagtaaaactagaaaccagcagagttaaaaaaaaaaaaaaagtgtatatgtaacatgaaatcagtatttagacttcttaggggactattccatgaagctattgcttgatttttcaggttattcacatctgctgaagaaacattttcacactgtaagtctgagcatcagtttaatattgacagcatggttcataaacatggtgagtagtttttagaataaaggcaatttaatttgtgaaatttgggcaggcatggcagctcacacctgtaatcccagcactttgggaggctgaggtgggtggatcactttaggtcgggagttcaagaccagcctggccaacatgctgaaaccccacctgtactaaaatacaaaagttatctgggtgtggtgacgcacacctgtaatagcagctgctcagaagactgaggcaggtgaattgcttaaacctgggaggcagaggtggcagtgagctgagatggtatcactgcactccagcctgggcaacagagtgagactcttctcaaaaaaaaaaaaaatctgtgaaatataagttcagattttatagtttttcagacccttttctgtacgagtttaatatggcgaatcacacagcaacatcttgtggaaatggagtttttttgacaagcggtccttgagaaaagatgaataagtcactcttctagacaagattcactgtatttaagcttat

SEQ ID NO: 7662 - DNA, 1188 bp, Homo sapiens
taaaatagtgtagatgataaatatttattattattattattacttttaagaccgagtctcactgtattgcccaggttggagtacagtggtgcgatcacagctcactgcaacctccgcttccgaggttcaagcaattcttctgcctcagcctcccaggtagctgggactaaaggctcgcatcaccagacctggctaactttttgtatttttttttttttagtagagataaggtttcaccaaattggccaggctggtcttgaactgttggcctcaagtgatctgcctgcctcggccttccaaagtgctgggattacaggcaagagccactgtgcaaagccaagatgattaatattcaattaaaagtactttcactaatctttctcaattggccacatagtagaaacttagggcgtatttattcctaacatatttatacttgttttattgttataagatggcctgataataatgtccatttatttctttagatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaagtaatttatcaatcttgcaaaattaattgttttagatctccagaataatacaacctaatggcaaagtagaatatagtagaacatttcatatactggaaagtacaatgtagatattttatcttcatactgttaaagatatgtagcatttttgtacactatggatatagttaattaatataaaatcttatagttttacctattctgatatgttctgacaaatgttgtcctcatgaatgtttttgttctttattgccttcctttcagttttcctgtttgcattgatttctccattttactttttctatcctagttttttaaagtggaaggattaatctttttgaggtttggggaaaatacagggttgaagtttttagttttaaagaatcaaaatgtaggccgggtgcggtggctcacacctgtaatctcagcactttgggaggccgaggcaggaggatcatgaggtcaggagtttgagaccagcctggccaacatggtgaaaccctgtctctactaaaaatacaaaaattagccgggttgtgg

SEQ ID NO: 7663 - DNA, 1255 bp, Homo sapiens
caaaaagaaagtcactagacaggaaattatttgggaagtggttttctagactagagtttctcaaccttagtgctattgacattttgggccaggccattctttcttgtaagaagctgtcctgtgcattgaaggatgtttaccaacataccttggctctacacagtagatgccagtagcatctcgttcatcccccacccccagttgcaacaatcaaaaattactcagacattgccacgtgttccccagcaggcaaaatcaagtggagaaccactgctctagatggatattgcatcattccagggagttatagggcttgttaataatgtctatccaaacattttttaatgaggaagaaagagtagtctggaaagtagaatcatagataaagaaaatgcagtatattttaccacaataaactttctgggttcactttataagctggcctgattttccaataacttactgcaaaaaaaagtttcagattttgcagaatattattacatctgtggcagaaaaaaaaatattctgtaattaaaagagtagcaccgatgtttaaattgacctgcttatgagagtattgcacatttctaaactctttttttcccctttttttatgcagggctattttcttctgtttgagtctatgttagattctgtcctttatgcaaagaacaaatacttggcaaaaggaggctcgggtgagtataaaattctggttttaataatctaattttagtctagcagaaccagatgaacctttggatttcaaataaactatgcatggctgaggaagttcccgatagggttgaaagatgtttgcattacaagaagctttaagacatttgtttactatattgttgaaagtagaatattatataagacatgggggactccaaggtaatggtattctcaagaatgcttttattaaaaggtccttttaataaatatctaaagactaggttttggaagctttttgatattcaaactcaaatctaacaaactcctttttatttttaatcctcatgtcatttagttcccttttttcccaatggcatatttcattctaagttggaaattattcacgacttcactaaatctgtaaacccgacttctctgtgattttctgagaacatttcaagtagtgactggtttctaatgagttttaaaagtgccacataaccaatccacatataaagggatcctaataaatttggaaggctttcttttcatgtctctggaaaacatttaatcatat

SEQ ID NO: 7664 - DNA, 1203 bp, Homo sapiens
atttgtcccacatgttccatgcttttcagagttaaaaattattagttccattcaagttcagttagtcaatgctttaataaagtatactgactatgtaataaagctagccatatttgagactgaagactaaaaattttaatttggctaaaatttattgagaacctactatataacattgtattgggtaaggggcatagaagtgagttatacatatgccttgctcttaaataaattgcagtataaggcaaactgtaatatactatcgtaactaacataacagaatgtataataaacacatttgctcatcaaatattgtattgtattgtatcctatgggccaggttactgctctgggcactgagagtatagtggtgaacaagacaggcatacaggaataaataagaaaacagttgaattggtctgtgaaggggtatcataagtatctggaaatcaactgataaagttatatttagaaatattctaattaaccacgtggtttttatgataatctgtggctgagtactacattgttttataattctatttggcagaattattactagtattttgattctctcttggtatctaaattgcagtgaacctcagggttaaatattgagtttggtttggacctaatccatattaaccctaccagatcaataaaatgtcacatttttaacaaaagtagcagagtacacaaattagctttaccatgatttttcaaaaaatcagtgtcctgttttttacactttctaagcttaatgtaatgccagctttaaaaagtgattaagtccagctagttccaatagtgaaagaaaatggaatggtatttaaatttaaccaaaaaactcaaaattatgtatttatctgagtatgttaatttctttaagagatcttttgtaggctgggtgcagtggctcacacctctaatcctagcactttgggaagccgaagtgggtgagtcgcaaggtcaggagttcgagaccagcctgaccaacatggtgaaaccccatctctactaaaaatataaaaattagccgggtgtggtggcgcacgcctgtagtcccatctactcagccttgcctgaccaacacggtgaaaccccgtctctactaaaaatataaaagccaggtgtggtggcgcacgcctgtggtcccatctactcaggaggctgaggcaggagaatcgcttgaacccaggaggc

SEQ ID NO: 7665 - DNA, 1531 bp, Homo sapiens
tgtagcagaataacaaaaacatgtcaggtttgcaacactgtcatagagtttcagccacactttaaattatttgcaaaaacaaatagtataaatagtatagcataaagtttttaaactatttcactccttcgagagaaactaacttgtggtgaaagaccagataggtgagatacccaaggtcaagccctgtccaatgcagggttagcaaactgcagccccggggccaaacccacctgccccctgttttgggaaataaaattttattgaacacagccacacttaattcatttttatactatctgtagctgcttttgtactatcatggcagagttgagtaactgtgacagactgtgtggcccacaaggctgaaaatacttaaccagctgtccctttacagagaaagttttccaactcctggccctgtaaggcttgtagtgatagcaaggtacatatttgctcttacagctgagagtgaggtgatgataatagagaagtcaattctgagtcaaacaaatttaggtaagatttattatctgaggccgggcacagtagctcacgcctgtagtcccagcagtttgggaggccgaggcgggtggatcgcctgaggtcagtagttcgagaccagcctgaacaacatggtaaaaccctgtctctactaaaaatacaaaattagctgggtgtggtggcgcatgcctgtaatcccagctactcaggaggctgaggcaggagaatggcttgaacccgggaggcggaggttgcagtgagctgagatcatgccactacactccagcctgggcaacaagagcaaaactctgtctaaaaaaataaataaataatctgtatagaaaacctactcagatgaagtaataaatttgtttttagttgcagccaagaaagaacagctaccttttggagcagagatgactaatgccatatataaagtatttcttcatataactcattaatggtcatggcagagaagatataaatgcacaacagaacacatagattttaagaactattttttttaatgtggagctaagcaactggatatattactccatttatgaacacaggattgattaaacctaaattgctaaaaaagatacagcatttacatacatgaaactgatgttttgagttgtaacaattagtgccttgtataaagggaattagtaaaactgaaaccttgtagctgattgtcaactccattttaaaagttttaattagaccagaagaaatctgcaaacagaacttttgtttgcttgtggttttgttttgaaatagggtctcactctgtcacccaggctggagtacagtggcgctatctcggcccactgcatccttgacctcccagggctcagttgatcctcccacctcagcctccctaatagctgggactacaggcacatgccaccacacctgggtaatttttctattttttatagagatggggcttcaccgcgttgcccaggctggcctccaactccaaagctcaagggatctgcccacctcagcctcccaaagtgct

SEQ ID NO: 7666 - DNA, 1799 bp, Homo sapiens
cagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaatctattttgccttaatttaaaact

SEQ ID NO: 7667 - DNA, 1182 bp, Homo sapiens
aattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcgcccgcctcggcctcccaaagtgctggaattactggcgtgagccaccatgcccagcctcaaatatgtttttaaaaaatatcattgtcctcctcctcttaagatttttttaagttattttgctcaagtacttaagtagtctggctcaagtactttgtttacaattaaaatggatattatagcatttaatagaagaaatggttatggct

SEQ ID NO: 7668 - DNA, 1229 bp, Homo sapiens
ttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaatt

SEQ ID NO: 7669 - DNA, 3623 bp, Homo sapiens
cgtctacaaaaaaaaatgtaaacaaaagtactaaaaaaatggtgagagaattattttataacttcagatcagaaaaagattactagctataatttttaaaatttaaaagcctaaaacaattaattttgattacatttaaaattctatatggcaaaaataccataattaaagataaaaggcaaagaacaaattgggaaaaatatttttcaacatatataaccaagggctaatttctctaacacctaaaaagttcttataaatcaataaaaagaaaaccaacatctcaatggaaaaagaacaaagctcataaagagttcacagaaaaaggatatacaaatggctttaaacatgtgaaagaatgttcaacttcactcacaataagaaaaaatacaaattatgagttgcttcagcatcctggtgttgctgtgccgtgggtcctgtgcggtcacttagccaagatgcctgaggaaacccagacccaagaccaaccgatggaggaggaggaggttgagacattcgcctttcaggcagaaattgcccagttgatgtcattgatcatcaatactttctactcgaacaaagagatctttctgagagagctcatttcaaattcatcagatgcattggacaaaatctggtatgaaagcttgacagatcccagtaaattagactctgggaaagagctgcatattaaccttataccaaacaaacaagatcaaactctcactattgtggatactggaattggaatgaccaaggctgacttgatcaataaccttggtactatcgccaagtctgggaccaaagcgttcatggaagctttgcaggctggtgcagatatctctatgattggccagttcggtgttagtttttattctgcttatttggttgctgagaaagtaactgtgatcaccaaacataatgatgatgagcagtacgcctgggagtcctcagcagggggatcattcacagtgaggacagacacaggtgaacgtatgggtcgtggaacaaaggttatcctacacctgaaagaagaccaaactgagtacttggaggaacaaagaataaaggagattgtgaagaaacattctcagcttattggatatcccattactctttttgtggagaaggaatgtgataaagaagtcagcgacgatgagactgaagaaaaggaagacaaagaagaagaaaaagaaaaagaagagaaagagtccaaagacaaacctgaaattgaagatgttggttctgatgaggaagaagaaaagaaggatggtgacaagaagaagaagaagactaaggaaaagtacatcgaccaagaagaactcaacaaaacaaagcccatctggaccagaaatcccgacgatattactaatgaggagtacggagaattctgcaagaacttgaccaatgactgggaagatcacttggcagtgaagcatttttcagttgaaggacagttggaattcagagcccttctatttgtcccatgacgtgctccttttgacctgtttgaaaacagaaagaaaaagaacaacatcaaattgtatgtacgcagagatttcatcatggataactgtgaggagctaatccctgaatatctgaacttcattagaggggtggtagactcggaggatctccctctaaacatttcccgtgagatgttgcaacaaagtaaaattttgaaagttatcaggaaaaatttggtcaaaaaatgcttagaactctttacagaactggcggaagataaagagaactgcaagaaattctatgagcagttctctaaaaacataaagcttggaatacaagaagactctcaaaatcggaagaagctttcagagctgttaaggtactacacgtctgcctctggtgatgagatggtttctctcaaggactactgcaccagaatgaaggaaaaacagaaacatatctattatatcacaggtgagaccaaggaccaggtagctaactcagcctttgtggaacgtcttgggaaacatggcttagaagtgatctatatgattgagcccattgatgagtactgtgtccaacagctgaaggaatttgaggggaagactttagtgccagtcaccaaagaaggcctggaacttccagaggatgaagaaaagaaaaagaaataggaagagaaaaaacaatgtttgagaacctctgcaaaaccatgaaagacatattggagaaaaaagttgaaaaggtggttgtgtcaaaccgattggtgacgtctccatgctgtattgtcacaagcacatatggctggacagaaaacatggagagaatcatgaaagctcaagccctaagagacaactcaacaatgggttatatggcagccaagaaacacctggagataaatcctgatgattccattattgagaccttaaggcaaaaggcagaggctgataagaatgacaagtctgtgaaggatctgctcatcttgctttacgaaactgcactcctgtcttctggcttcagtctggaagatccccagacacatgctaacaggacctacaggatgatcaaacttggtctgggtattgatgaagatgatcctgctgctgatgataccagtgctgctgtaactgaagaaatgccgcccctcgaaggagatgacgacacatcatgcatggaagaagtagactaacctctggctaagggatgacttaactgttcaatactctacaattcctccgataatatatattcaaggatgtttttctttatttttgttaatattaaaaagtctgtacggcatgacaacaactactttaaggggaagataagatttctgtctactaagtgatgctgtgataccttaggcactaaagcagagctagtaatgctttttgagtttcacgtcggtttattttcacagattggggtaacgtgcgttgtaagatgtatgtaacatgatgttaactttgtggtctaaagtgtttagctgtcaagccggattcctaagtagaccaaatcttgttatcgaagtgttcctgagctataccttgatgtttagaaaagtatttgttacatcttgtaggatctactttttgaacttttcatcccctatagttgacaattctgcatgtactagtcctctagaaataggttaaactgaagcaacttgatggaaggatctctccacagggcttgttttccaaagaaaagtattgtttggaggagcaaagttataagcctacctaagcatatcataaagctgtttaaaaataactcagacccggtcttgtggatggaaatgtagtgctcgagtcacattcttcttatagttgtaacaaatacagatgagttaaaagaaaaaaaaagaaaaaatacaaattatggctacactgaagaaaacattgttcacctaccattttggcaaagctccaaaaatttgatatgggactcacacacttcatatatatataccttaaagtgtctgtatttttgctgtgttgccccattcttttcaagatggtaaaggcatgcaccttggagtcaaacagacatgagtttaaattctgattgtgctgctcccagcttgtcattttgggtaaatgatatcatttctttaagcctcagttttcctcatctgcagaatggataagacagttttg

SEQ ID NO: 7670 - DNA, 1160 bp, Homo sapiens
tatattatagtgttgtatttaaattggcttactcgttattcttttgatagaatgacatatgcttttttctctacccagagatttaagaaatttttaagaaaatatgaaagacctggtttgacataggaatttttctaacttatgaatatattgtatcccttcacaaagatatacaataaattgtgtttatcagcagtaataaaattacattaaaccagctctggtgtttgaaacccaagatgtatagtttccatatccatgtctttatacaacactaagcactcaataaatatatatcggttaaatcatgtaataatagaatgtgctcccttccattgatcatagactttagaaagacttcaatctaacagaagtgttttctctatctcctgggtttactcacagtaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtgagtattcataaagcatttcatctcacaacaagaaatcaatttgtcaaaaacactctgaatttaatttttttaagactacagaatttccattacatgcctacacctaacactaccaatacataataaatcagtttgtttcatactcattatacacatcagtatttctctggatttgggatttttaaagaaaaacaatgattgcctttacacaaaatagtgaagaggataactttcatactgattatcttttttacttacacaatatgggttttagagtgttaaccaatgtcagtaaatatcatgatactgcaacaacgatttcatttttttgcatgcccaactatgcctcttgtgagaagcaaaaagaactacatatatttaatgcatcctcttttagcatacagaaaaaaaaaaaaggcaagatcctagaagtcagtaagtgtgttttgtcctgtcttatgcagtcactttgtttgaaccttctccagagaaactgtaatttatgatatgatatcaaacacagtactataataagatatcttttacacctcctcttcctg

SEQ ID NO: 7671 - DNA, 1167 bp, Homo sapiens
aatcttagaagttattccatttctctgggcctcagtttccgttactccaaaatgagggtgctggactacagcagggaagattaataggtttcatcttacagatcagctctgatccgttgataatggccatcaccagagcacagtgctgagaattctgagagcacctctaggtttatcaggacagaggggcacgatccattagcagtgtctgccatcagcactggttgggggaaagcacatcaaccttggaaggataaacttgaagattccttccagcctccttggatcattgattctgttgtagttgtatgtgcattttggattgtgcaggtgtttgatcttttgctggaccagcatcacacaagccttgataatataacagccttgtgcctgtgtgtgggtttctttttttttttttttgtactgcaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggtaagaggtgctgcaggagcgatgacacagtgggggcccagatcacaagctttttgtagactctctcttctcttatcatatccactcccttcagggagatgtcacagcctcctaagtagaacctgcttgtataacaccctcctctgtaaactcagaatgtactgagttgcttacactgaatgaagttacaggtgggagggaagggctgtgagggctaataaaaaaaatcccttagattgagaccccatctcaacttcgtctcagatgcacacacggagaagaaagcagaaaggaagtgtgtctgtggtatattttcaaaatgctgcctaattctggatagcaaggattgagtgggccggagcagtcagggaaggcttcctggtgtgggtggtttggaaactggagccttggagaatggatttatatttggagaaggtgggtcaactggaggggcaaagatgcagcaatgcatgcagtaatgggaagggtttagatccaagacaaacaagatcgggagaaggaaggagaaatgagattacagagg

SEQ ID NO: 7672 - DNA, 2082 bp, Homo sapiens
ttctggctttaatgcctagtacttcggtatctattgataaacatccaaataaacaaatcaatacatttagaaaaatgtcctgcctattccccactttgctgattgcccccaaattctcaggttatgccaacagtcagtttaggcagcgaggctgtaagaggaaagtggcattcttgagggcctattttgggaagaccaacactgcttgtgggcacaaatggattctagcttctgaattactcggggacttccctgacacgttagcacggtttttatagcaagaggctgttccgatttggagttttgcaatgcagtcatggtagatgaaggaggtgcccagtagcttctggattactaaatatagtattttaaatgttgtacatcagtgaaatgacatgaacatcatacagaactagtacagttaccagagcttccatgacagtgctctttgatctcttctataggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatcttcctgaaaaaggttgcacctggaaaatctggacttcttccctgggcctatgaggcgctgtaggaggaggcctatgggatctggcccctaccagcagtagcatcatctccttaccactgtccctttcataccgcctatagtctggccccagagactttctagtcctcagacacaccaaggtcattcccaggttgggccctttgcacttgctgccccctcacattcag

SEQ ID NO: 7673 - DNA, 3559 bp, Homo sapiens
ttctcaactgattaacaaatgattacccttttgccaaggtaatgtctgtaacttttctagtagctgtggttatgtgtgtacttgagagcaatactattgttcatttctttcaaaaaaatgaaatctgccaagtcagattgatttcttctccccagcaaccacacccccaccaaaccctttgggttatattatcaaaaagatttttgctgtatgctggaagtccagcagggtgcagactacatgagagaaattctgaaggtgatccatgggggctgtagtgtgtctaaggagccactggacctcatggaggaaaacctgtggctcttgtgggattgccaagatggatgaggtgagggaggggtcttcaacattatttgaaatagttgttgaatacagtatttccgttttagtttttcagaaagaggacagaatttgagattgtgctttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaaggtttgtttttaatttttttctaatatttcctaataaaatcttttaaatttttcttgtgaattatagagtcgtccctcattatctgaggcaaggaggatttggaaccctcagatacagaaggctgactgtatttatatgttttgaatttcagactacaggacttttaaatagataggtagtggttgtatgtattttgggggcacaggtgatattttgatacatgtatgcaatgtgtaattatcaaatcagggtaattggaatatcacacatcttttctttatgttggaaacattcaacagttctcttctagctctttcaactatacaatacattgttaaccagagtctaagcactgttgttttcaatcttaccttcacacatgctttcagtttgtgtaatctattatacctataaagtaaacctattttgagaaaacctttattttatacataggtgtatttcttaagtgttattacactaaatgcttatagtcttagaataaaatgaaaaaaatgaagctctttcctgttcataagtttcagattaacatcaaatgggatacagtttcaagtaatctaatagccatttaattattaggccagtttcctgtttattgagatagaatgggaaattttcagaattgttgagttcggaaatctctagttaaggtttagagatcaaacttggatgctgatttcggcagcacatatacaaaaaaattagattaaatttgggatatgattaatatctgtaatacttaaaaataactaattcaagcagagagctgacagctttaatttctgatttcctatatgtatacacaaagttttccttaattaagaaagtatcctagtcctaaatcataccagtaacttccaaatgattgaatatcatgacagtgaaaattgaaactttatatacatgtaaatcagtctctgttttactagttagaaaccacatcataggccaggcatagtggctcacgcctgtaatcccagcactttgggaggccgaggcaggtggatcacatggtcaagagttcaagaccagcctggccaatatggtgaaaccccgtctctactaaaaatacaaaaattagccgggcgtggtggcgggtgcctgtagtcccagctacttgggaggctgagacgggagaatcgcttgaacctgggaggcggaggttgcagtgagccgagatcgcaccactgcaccccagcctgggcaagagagcaagacttcatctgaaaaaaaaaaaaaaaaaaaaaaagaaaccacatcttaggtatcaatttccttcctctttaataaaatatacaagttgctttctgaatgcgaaagtgtcttacatttgatggtcttcattgtattaaaacactggaaatgcatatttaactagacgcattgagtattgtagtatcactgttgattgtgttatccatacttgtgtagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtaagttaagatctgaaagaaactcagtttttctaggtgcttttttcatgttactaacttttaatggtgcagagcaggaattctggaacttgactctcagctgtggctcatattagctgtgaccttgggcaagtggcttgacctttctgtgccctagtttcctcctttgtaatatgaagttgttaacggtacctgccacaggtttgtggtgagagctaacctcaacttaaaactggttgctgatttcaaacattgtttatttgtttgttaaccaaccaggttaagcaaccttttccacgggatggataagaatactcctgtaagatacacagtgtattgcagccttattaaagtggcagcatcttgtggggccatccagtacatcccaactgagctggatcaagtgagttactgtgtggaatagttgttctgcttataagaaatgtactttttttttttttgagacggagtttcactgttgttgcccaggctggagtgcaatggcgcaatctcagctcaccgcaacctccgcctccagggttcaagcagttctccttcctctgcctcctgagcagctgggattacaggcatgcgccaccacgcccggctaatgttgtatttttagtagagacggggtttctctatgttggtcaggctggtctcgaactcccgacttcagttgatcctcctgccttggcctcccaaagtgctggggattataggcgtgagccaccacgcccagccagaaatgtacttttatatgttatactttatatgtgttactcagttttctccttttgtcaatctcttgtaggttagaaaatggatttctgactggaatctcaccactgaaaaaaagcacacccttttaagactactttatgaggcacttgtggattgtaagaagaggtattcaaaagtaatgaactaacatatcacttaacagacagtataagtaggtggggatgttttttaaagagaagtagggccagtaattttgctttactctgttctccacagagttgctataaatctatttctataaatttgacctaaagttaaagataactataaagattaaaagtagttttccctcatctttgaactttttaaaaagtgaaatttggctttttttctaaaaaaagaaaggtggggcctttccaacatgggcttcaacctactgctgtagcatgagcttggtgaatgtggtgaagcatctcatcatttttggatggtgcagtggcagactacaaaaaactttgtgttaatgtaaatattccatctctccacccatgtccttcctcttgcttatcacactctagacccagcgagcctatgtcaggtataaaa

SEQ ID NO: 7674 - DNA, 7300 bp, Homo sapiens
gtgcccggctacctccctttctttcatcttctcacttactcatcattatagacttagataatacaagtttcttttttattacatatatattgttcctagccccacttaggaatataagtctgatatttaaaaacacatgaacatttttcaaatgcaagtataaatatattttggactgttgtgcatctggactatgccattagccatcatctttcagtgtggataatttagagctcagtgtatttactgattatttcattttaaaagtgagccatgtgaaagcagatggtttggtaatttgatgaaacagaatgatatttctgccttgaacaaaatgtaggagtcagtatctttaaaataatatttacaatatcttagaatatcttacaataaatctgaattctgtattgatggtatcttttttgtctcttatctgtatagcttttaaccatttttgtgagtgctaaattggcatcatatgtcaagttttatcagaataataaagacttcattgattcacttggtaagttttggggtttattctttgaggcacagaggtgggaacatgatacactaacagttatgtactatgtgttccagcaagtatggctgtggccttatttgtagattatcctaaaaggagtcgtgtatgatagaacagcacaaaaataggtagacagtttaaaatattacttagaatgaattgagaatcagaaaccaagaaggtgtaggaggtggcatttgtgatagaaagagaatgaaactgggagtatgaaaacaactcggggcccagcgcggtggcttagaggtataatcccagcactttggaggccgaggcgggcggatcacgaggtcaggaggtcgagaccatcttggctgactaacatggtgaaaccctgtctctactaaaaatacaaaaaattagccgggcgcggtggcgggtgcccgtagtcccagctacttgagaggctgaggcaggagaatagcttgaacccgggagatggaggcggaggttgcagtgagccaagactgtgccactgcactccagcctcggcaacagagcaagagtctgtctcaaaaaaaaaaaaaaaaaaaagaaagaaaagaaaacaacttagcacttgtaatcccagcactttgggaggatgaggtgggtggatcacttgaggtcaggagttcaagaccagcctggccaacatggcaaaaccccatttctactaaaaatacaaaaattagtgggcatggtggcacatacctgtagtgccaactactcaggagccttaggcaagagaaccacttgaacccgggaggcagaggttgcagtgagttcagatcacactgctgcactccagcctggatgacagagtgaggctccatctcaaaaaacaaaaaaaaaagagagagaaaatgacttggaacctttttgtctcatttaagagcttgctgaactttaggcccttccagctcttctgtaccatgattctttgaggtaaagttatatcaacaatcgggtgtttggagaagattgaagaaatagttccattggtacatttgtttttaaaatttagagatggaggagtgagcagaaaagcaactgaaagaattaccattactttgatcataatggtaactttcagaaatgttttaagagctgataaaatttgatgattaaaggtactttattaagctaaacattattcttaaaataatattgtttctttgtagaagactttattccttagatatatggtgatttgtatttttggtccctttttttaagccatagccacagaatggtaacaaatagttttttcccccctactatactattttatgcttggatacccccgccattaacaaattacaaaagtatatagtattgccagttagatctgaaagatggaattagaaatggaaatgtaattttacatgatagtaagacttttctaactacgtttgttgaaaacagcatagtctttattatttttatctttgaattttcttgtctagcgtatcagttcagtaaatgtttgtcaaattgaatcaaatcttattcatccttattgagcaaaccctacatatgttcaatattttaatttccttctggagcatgtttttaacatactaaaatacaaagagaaaactcagaaaatctgcagttgaacaggttttaaatgttgtaaactaccagtttctttacactggagtcaactgtgaaactaaggtgctttgttctcctactaggcaataatcaaaacacattagagattgattatattttccatattaagactgaatttttttttgtttttgagactagtcttcctggttcttgacgatacagatgaatgtatggtctattttgatagtcttcaatttggtaatcattaatgcttgtcacctgtaaattgtgtgcctccattggaattggggaagattgacttattctgaacataataaggcatttgaaatacaccaagataaagtagatgtaagtgtgtttgtgtagaaagctttgccaggtgcactagacccagaaaaccacattctgtcccagttaatttgttttgtggcatgaagctatgtgatggaatgttaatgtcagcaacctctttatttacgcaccaaggaaaaaggagtagtaattaacactttgacactcccccattgatgtgtaattgactgtttcaaaggagcactggttcataagctattgcatgcattaaaactgggttttctatattgcagcattttaagacaggggtcagtgacaatgcagaaattgctcaatgatgcactttttttattactgcattaaggttttgacatattagtaatgaataaatgtttccataaaattagattttttataactttaaaattgaaatatgacacagtacactgtgacttcctctttgatggtagtattttagttttatgaaacaaagcacagcttcctacaaagtctttaactcatacttcactgccttagtagtttgatttttcagaacaagagtcctaagggttttaagtttggttctttgttactttaaacatcaatttaaagtgtttttagatgcaagttttcacatgtaaaatagataacggttttatggaattcagcctagaaataatcttcattcctctgataagttttttcatttatggtaagattgtaactgcagaaaagataagcagtaaaatagatttaatttcaggagtatttaaaataatagaaatttcagaagtttctatcactttatattgaaagagagttgtctgtccatgccaatagaactgagaatgttaaggaatttttgaaaaaaatctttaatacttattcattgataagaaaaaattcgttaacattgctaatttattgtgccagctagaattcaaattccttcatttgccttacgtttcttgaacatctatgcaaatcagtattctattagaaatttgtttatatgcttttcagaaaacatctttatattaatgtgtatattttttattttaattctataattaaacatttattacagctgaaagcctagtgacaactatctagattccacaagttgcaatcagtttgtcagaacattttcctttattaacactgacaacttaggccaacagtagcattatcttgtgtcaactgaattgccctaacatgtccacatgtaatctggtgttatccagttgctaccttttgcttcagaaagttaatcggcatctaatttgcattgttaattagggttaatgtgcactaattgatttcttggcgcctgtagatttccattaaacccagttagcaatacttccttgtatacctcattcatttgagttatggtgatcatgtttttgttgaatctgtgccaaataggaagcctgtatcataattacagctaattaacagatgatcatgtcctatgttaatgggcttccctaatcttccactaatatatgaatgttataaatttaaaatttatttatggagtgtttagagagtgaactttttaaacaatacagacttgaagctctgaatttattacagggcacttgattgatcatttgctgattttacatagttcaaaagttcagagaaaaggaacatgtaaatctagattagttttagaaacttagttttataattaataagttagcatcaaaacaagtatatatgatattatgttagaattctgctcctacttaggactaggttatatatttaggattcctaatttttaaaatttctagccctttattttagaaatgaacctattctaggcctagcactgctattttttgactataagtccccatttaatctctttgctcctcagttttgtttttaaagtgaaaggatcaggactgggtaattccttaagttttcttctaggcctaacacattgttgttatttgaataattacaacagcatgtttcattagaaattataatgcaaaatttgaattatttgtgcaattttctacttttgtcttataaagaacaagtatcacttttaatggtattctttaattatatctagtactaactgtattggcctataaatgttaaatgacacacacactttgacagttttggtttgtaagtagttttgatttttaaatagtgacctgaagcaaaatggaatgttttcataactgaaaatgtttgtgaaagtattttaaaacttcaggtttaccagtaatagtaacacagaaaaaactaataagtagataagaaatcctctgtgtttaaatgaagagctattagtgtgaaaaataagcttaggtaatttaactaaatagaaattgttcttatgaaatgtactttgtagattttatctcctaaaatgtataactatttaaaaatgtaaaatgtgcaaaacttttagggtctaaaaataatcattttatggccgattcttaactttgaatctatcacctatggtactatagaaaaattgtttttaatactctgtggagtcagtttatagtttgcaaatataagaagctttgtcaaaattgttctatataagtgctcaaacaataatttccacaattacaaaagtaaaaataatttccacagcttaacatgagatgtaattgtgcaggtctttaattagtatgaacactcatcaggcttcactattctgttttctaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattctttaaaaaaaaaaaaaaaaaaaaaacagcaaaaaactgtatgcagtatttatttaatatagattgtcccagcagccataggacaaatgcatgacctttcttttggttgccccatactgttttgcttattagatttaaacagtgtataatgttggaaaacagtataaagttttattatggcttacttggtcacagttttcataccttagctatttttcttggaaattttccatataacatacgatataaaacatcttttttcagccgtaagaactaaaatggtctactgcaaaattgatcagacccagagaaaagtagttgtcaggtaagatatttaatgctttgcagcattttatagaacgatttagtttgttccgattatttcacttaaatgtttagagaaccaaggtggtgttatcacttgactgtagttaaatagttgctatttatcataattttattaaagttcagactgaatgtgattagcttatttaatgaaagagtcctattttccagcacatttcatttaatggctgagcattggctagaatactaatgacttttatgtctgctttatatagttgctcaggagaattagaaggcttaggatcaatatggtaaagattttttttaaataattatgtaattcttaaattctcttactattctaaattaggtatatttaatcttgcttttaactggattcaaatctgtagtattataaaagaataccagaggctaaaaggttgactaacactgtgtttaatttttcaatttttagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgt

SEQ ID NO: 7675 - DNA, 1819 bp, Homo sapiens
ttaagaatgtagcagcatataagctataaatttctggagtatatgcacacaaatttatctgggtgggtatgtaggtatatgtgagtttgtttcctcttccaggagctcaagaaataacatactcctgaaaaatagaatagaaatttctgtgctttatgtttttgccaggctattacattttcttatcatttaggatcacttataaaatgatcattgtttattttgttttataatttttacaggagtgagactgcaaacccacatgtttgatagttcctaccaaattaaaagtttagaaagcataaatcatattacagtgcatatgtgagtgtatgtctctcttttaagatgcatcatcttaaggcagataaaagtaagtccttaatcattacagactgccaaagactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggttggtgacaactgggtttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgctctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattccatatagaatattctcttttgataatgaaaaaaattaaagagagcacaaactttgactatgtcaaagtatttttatttttaattttttgagacaaggtcttgctctgctacccaggctggagtgcagtggtgcaatcacaactcactgtagcctgaacttcggggctcaagcaatcctcccacctcagcctcctaagtagctgggaccacaggtgcacctcggtacacctggctaatttttgtgttttttgtagagacagggtttcaccatgttgccc

SEQ ID NO: 7676 - DNA, 1107 bp, Homo sapiens
tttccagaaggagtctcactttgtcacccaggctggagtgcagtggagtgatcatggctcactgcaacctccgcctcccaggttcaaggatttctcctgcctcagcctcctgagtagctgcattacaggcacctgccagcacgccttgcaaatttttgtatttttagtggagatggggttttgccatgttggccaggctggtctcaaactcctgacctcaggtgatccgcccgcctcagcctcccaaagggctgggattacaggcgtgagccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagtatttattgcttgtttcatttaagcattcttcctcatataatggcatataatgaaatatgatattatattaattaaatttgaacaacacattgagtgttttcaaaacaatatttatagcatgatgtcaatgtatatctttcacccaatggg

SEQ ID NO: 7677 - DNA, 1132 bp, Homo sapiens
gacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactgtaactcctgaaaatcagacgcttaattattcatctaatcagcaagaggtattgtcttcagttacaaatgagaattaccctgctcaaacaagagatctgtcttcagtaagtcagtc

SEQ ID NO: 7678 - DNA, 1550 bp, Homo sapiens
cagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaa

SEQ ID NO: 7679 - DNA, 1159 bp, Homo sapiens
cactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttga

SEQ ID NO: 7680 - DNA, 1175 bp, Homo sapiens
ttactgattatgtaagcaaaacatgttatttttacaaattcatatatgtttttgtgcatatattaacattagtatatttattagtctttattttacagaaattgatcataggtgacttacatttttaaacatgtcttagatatctttttacataaataaaaataggtctatctgttcttttcctccctggctttctgaggatagactgccatcatgaacggcacggtaactatccgcgttagaaagttcatgtccaaccgactacttcagaggaaacaaatggtcattgatgtccttcaccctgggaaggcaacagtgcctaagacagaaattcagggaaaactagccaaaatgtacaagaccataccggatgtcatctttgtatttggattcagagctcattttggcggtggcaagacaactggctttggcatgatttatgattccctggattatgcagagaaaaatgaatccaaacattgacttgcaagacatggcctttgtgagaagaaaaagacctcaagaaagcaacgaaaggaacgcaagaacagaatgaagacagtcaggggaagtgcaaaggccagtgctggtgctggcaaaaagccgaaggagtaaaggtgctgcaatcatgttatttgtggctgttgtggatttttcacaagaagattaataaactataaactttaaaaagtaaagatctatcttatttgttttaatgctgcaatgtattccattttatggctgtaccatagtcacttatctaaaccctctaaggtacatatttctttctttctttttttttttttttgagatggagtttcactctgttgcccaggttggagtacagtggtgcaatcttggctcactgcaatctttgcctcctgggttcaagcaattcttgtgcctcagcctcccaagtagctgggattacaggcatacgccaccacacctagctaatttttgtatttctagtagagacagggttttaccatgttggctgggctggtctcgaactcctgacctcaagtgatctgcccgcctcagcctcccagagtgctgggagtacaggcgtgagccactgtgcctggccagttacacttttcatttccacattttaacatttctgaaattacttcttggttattttatttatttattttgagacagggtctcgt

SEQ ID NO: 7681 - DNA, 2101 bp, Homo sapiens
ttcaccgtgttggccaggctggtcttggactcctgacctcaagtgatccaactgcctcagcctctcaaagtgctaggattacagggatctatacttttcttttgagggaaaatgttggcaccgtttctagggcatattggccatttcagcttctcagtaaatatttgttaagtaattaaatgcacttgattctttattcttagccttttaacgcaatactcagaatagctgaagcaccaattaactgaaatggagatattataaagatagttatcttctccaagggaaaaaatcatcttcatggaaattaattacttttttacaaattgtgaatttgacccttaagagttttcttcctgatatttaaaattgaaaaaaaaattgttgacattaatatttcttctttccttttttttcttttcctttttttttttttttttgcaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacaggtaggtaacaactccatactttttggttgtttattaatgtgaaatttctgctaaatgaaatacttttgtgtgtgtttgtggtagaagagaccacttcagttaaataaggaaatcaagagaggatcaatttaggttcgttttaaagagattaaaaaaaatcaagacataaaatctacccaagcaggatagaaatctccactgcaaagttccatgccaaagacatctggttatttttatttttaatggaagacttgaaggaatgataggtgattaataatgatcaaacagaagtctttaaatgttggaaagtatttacattaatctttgtatatatcattgggcattttagcacttgagagaaatagtttattaaagatataatcaatcatatgtaactgaacatttagaaaaattatatacaggtttgagtagcccttatctgaaacttttggggccagaagtgttttggattccagatttttccggattttggaatatttgcactgccaactagttaagcacccccaaatttgaaaattcgtttcctttgagtgtcat

SEQ ID NO: 7682 - DNA, 1164 bp, Homo sapiens
caggaggctgagtcaggagaatggcatgaacccaggaggtggagcttgcagtgaaccgagtttgcgccactgcactccagcctgggcaacagagcgagactccgtctaaagaagaagaaggaaaaaaaaaaaaaaaaaaaaaaatatatatatatatatatatatatatatatatatatatatatatatatgcaagatttgcaagtaccactgtcctagttttaaaagtcagttattggtagttaatactgtgttctgtggttgactttaaacttattaatgaccctgtcagaaagatgccgggagaagaagagagaagaacccccctaagtcccattggtttacttttcttgacacagataatatatttccaaacaagtgaccttctgtgtgtgtgatgtcctagcccaaaagaggtcattgtggccgccctacctgctgcatagggattgtgatgacaaaattaggagacactgaaattctgaaaatttataatcaagctgtattgtaacagtcgaggattggtaaacaaattataatgccacatcttagtggagataatatgcaaccttatccaatatggaaaaatgattttgttatgttaaaagagaaaaggcagtgcgaagttggatgtgcattgtgatcacaggtctgtccagcaagcaaaccaaagcttttccaagaacatcatctggaaataaaatttaccacagtatgagtcatggttttcttgatgcggtgggatgtgcacgtggtcagggcagagggaggaatggaattcttcttcttttctttctatttttccatcttttctaaattttctgtaatgatcatgtaaacccaggttaaaaagaagtgaaagtgaaattctattacttttaaaatggggaggcagagaggccagttgcggtggctcacgcctgtaatcccagcactttcagacgccaaggcaggtggatctttgaggtcaggagttggagaacagcctaatcaatatggtaaaaccccgtctctactaaaaatacaaaaaatttagccagccatgatggcgggtgcctgtagtcccagctacttgggaggctgaggcaggagaattgcttgaacatgggaggcggaggttgcaggagccgagattgcgccactgcactccagcctgtgcgagga

SEQ ID NO: 7683 - DNA, 1152 bp, Homo sapiens
ggtatattctctatatattctgaatattaactacttaccagatatatgatttgcaaatatttttcatttattctatgaattgctttttcactctgctggtagtgttttttgatgcacagaagtttttaattttgatgaagtctaatttgcctactttttcttttgtttgcctgtgtcatgtccaacaaatcattgccaaatactgtgtgtcatgaagtttttcccctatgttttcccataaaagtcctacggttttagatattacatttagatctttgatccctttggagttacttttggtagatggtgttaagtaaggatccaacttcattcttttgggatcacatgtgaatattcagttttcctaatgtgttaaaaagactgtcctttccccattgaatagccttggcacctctgtcaaaaaacatttgaccatatacaagagggtttatttctgggctctctcttctattccatttgtctagatgtctgcctttatgccagcactacattgttttgattaccatagctttgtagtaagttttgaaatcaggaagtatgggacctccaacttcgttcttccttttcaagattgctttggctactcaaagccccttgagattccatgggaattttagggctaatttttctatttctgtgaaaaacagtcactgggattttgataggaattacattaaatcttcagattcctttgggtagtaacaatcaatataaagtctcccaatccataagcacaggaagtctttccatttatttgtcttctttaatatactaattttttgtaagaaaaattagtaagaaaaattgtaagaaaaattaggtaagaaaagtgaggtcattcttgatgtatacttaagactagctccaaaaataagaggcctacgggttcaaagtcatggcactgatccctgaaattcatgccctgtcccccaatagaagcagtccctacagggaacactttcctgtcactctttaactcttagattcctgtagcctctaacctcatctcttacttacccctcactcatgccatgattcatttagctaagaagacctataggctgatggaacagaaagctgttgtttgcctacccagcatccatcctcccttcttgatagcatcacaatttt

SEQ ID NO: 7684 - DNA, 1205 bp, Homo sapiens
ctgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaag

SEQ ID NO: 7685 - DNA, 1150 bp, Homo sapiens
gaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttcc

SEQ ID NO: 7686 - DNA, 1173 bp, Homo sapiens
tttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgattttttttttttttggtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttgacctgccttgtggaaaatgttttctctcaaggatgagaaataaaatgagaattctggacttacttcttatcaacattaaaaaagccatgggggttgtatttgttgacctttcctgtttgtatattagtt

SEQ ID NO: 7687 - DNA, 1153 bp, Homo sapiens
atatgcataatgaaaaacttcagatatatatacctaactaaagaaaacaatacaatgaaactctttgtacctgtacccagcttgtatatttatcatctcatggtcaatcgtatttcatataaatccacattcatttccttgctccctttgccctctagattattttcaaacaagccccaaacacattgtttcatcagtaatagttcagtagtaaaataccttctagggaaagagctgttctgaatttttaacaattgcttaaaatagattatgtttaaaactatttgtaagtcaggaatcatccttttgtgtattgaggtcatatctcactcattgagtaaaacatgttttatttaagctggacctgaaatggattgaactaagttttatataactaattttggtgttttacttttatattgttttgcagattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggtattagtggtatttgataatagaaacttctgagtatttaagttgacaactgaaaggttattaattagctatttactattaaaaggttgaatgaacagtatgaacatgcctccattcacctgtgggacctgctggaagggaaggaaaaacctgtatgtggaaccacctgtgagtatcactgtgataactttgattttataactaggaatctttaaaaactaattttcttatgtttatagttcacttggaagaaaaaaattagtttttttttttttttggagacagagtctactctgttgcccaggttggagtgtagtagtgtgatctcagctcacagcaacctccgcctcccaggtttaagtgatttctatcacctcatcctcccaagtagctgggattacaggcatgcgccaccacgcctggctattttttgtatttttagtagagacagggtttcgccatgtaggccaggctggtctcgaac

SEQ ID NO: 7688 - DNA, 1215 bp, Homo sapiens
catggtggctcatgcctgttaatcccagccctttgggaagccaaggtgggcatatcgcctgaggtcagaccttcactaggcaacatggtaaaaccttgcctctactgaaaatacaaaaattggctggacgtggtggtacacgcctgtaatctcagctacttgggtggctgaggaacaagaattgcttgaatctgggaggcagaggttgcagtgagctgagataacgccactgcactccagcctgggtttcagagcaagactgtatctcaaaaacaaacaaacaaaaaccccgtaaagtttaatataactacattcttcttgttccctatcattctgtaatacatttctgttcttggtgaaatgtaatctttttatgtgtatatgtgttttagtaacagttattttttaatcacaatattttatagaatgttggatcttcttcaagccaggcatcctcagataagtcttacattataattcatgttctttttcttagataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctggtgagtattaggtggatatcaactttagtttagggtcctggttttatttgattttgctacaaatttaaactatacacttacttagttttcatatatgtacactagattttatttttaaagagactttaagcatgacaaagtttttttttttttttttttttttttttttttttttggagacagagtctcgctctgttgcccaggctggagtgcagtggcgtgatctcggctcactgcaagctccgcctcctgggttcacgccattctcctgcctcagcctcctgagcagctgtgactacaggcgcccgccaccacgcccggctatttttttgaatttttagtaaagacggggtttcactgtgttggccaggatggtctcgatcccttgacctcgtgatccacccgcctcggcctcccaaagtgctgagattacaggcgtgagccactgcgcccggccttgacaaaatgttaagacagattatcaagagtaattcctaccagtattcattatatttgtcttagtagtcatttgtcttactagtcttgatcactattataaactgatagatagttcttttgca

SEQ ID NO: 7689 - DNA, 1953 bp, Homo sapiens
acacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtat

SEQ ID NO: 7690 - DNA, 1165 bp, Homo sapiens
cactctgtcacccaagctggagtgcagtggcatgatcacggctcactgtaacttcgaacccctggcctcaagcagttctcctgcctcaacctcctaaggtgctgagattacaggcatgatccactacatctggacagattacattgaaagaggaatcctctcaccactttttccaagagagggcaacatacctgtgttctgaaatttcagttaagttttgatgatataaaggcttttgcctatagcttattcagaagtgagaggagaacttgaggcccctagtctggtatttaccctggttccagtgcgaggcctgatgagggccctctggggtaatacgtacctggtctttgagtgcaaatagcaggctgggtgagagcttacaggttgcatttctgtgctcattgaggtggtctgcactggtaaacttggcttctctggtggttcctgggccatgatgggaactgactgggcacagcccagaggtctttgaactgtcaggtgtgttcagggttctaggtcaccctgagccaaatgagcagcatgggtcgctgcccttgagagggaagatagctgcagtgacacctcccgcttagggctgagtcccagcaggctggcttcccttttcattctggaaatatgatcagcagctacatagctctctatgcagctccagctgcaggccctaggcttttttgattcacttcctggtaccctctttatcacaaaagagaaggagtgagtgataggataaagcaggagaaactgattctagttaagtagtgttataagaaaacaaatggcctatgaccaaaaaaaaccaaaaagttaatagaaaaagagtacataaaaaaataagaagtggtgtttccacttggcagtttcactctgcagaaacaactgctattaacagtttattatgtatcctgctgcctcttttttcatgcacataaatgaattaaatgcgaaggggtcatactacagagtgtaagtggtcccctgttagacatttcgattgattccagcatttccactgttagaaacagtgctcttaggggattcttacagataagtctgtgggcactatatttaggatacgtttccagaagagaagttgctggatgagaggttgtgtgtattcaaatgggtgttgtaccagttgatg

SEQ ID NO: 7691 - DNA, 1218 bp, Homo sapiens
gctgaggcaggcggatcgcctgaggttaggagttcgagaccagcctgcccaacatggtgaaaccctgtctctactaaaaatataaaaactagctgggcgtggtggcaagcgcctgtaatctcagttactcaggaggctgaggcaggaaaatcgcttgaacctgggaggtggaggttgcagtgagccgagatcgcaccattgcactccagcctgggcaacaagagtgaaactccatctcagaaggaaaaaaaaagtctgatgtgcagggaagtggtccagactgaagctgtaaatttgagttatcagcatctattaaaaattggtaccaaaggccttgagactgaaatgagatgaccaagggagtgagaagtccaggtgctgagcagtgctttctggcctgcaagaactgccgccctcttatttagcctggcatcaacctcacttctccacagtgatggtgatgaatggtggaaacttgggtctttcttggagttcacctaatatgtttctgtttccacaggccaaagctgtcttgaaatttatcgagggcatctctgaaaagaccctgaggagtactgttgcactcacagctgctcgaggacggggaaaatctgcagccctgggattggcgattgctggggcggtggcatttgggtaaggggattcagtcccccatctttaggaactctgggctctgtgggggtagtgtgcagggttggggtcagaggactggtatctcacgttcctagttctgagttctgagtgggttcagtgtgtgatttctctaggtcttgatttcctgccaggaaacagcagcactgtttccccaacccaccctaaaggtgcatgtttacttgtgtgtacacacagacacatatataccagggcctttgtaatcactatttacagttgaacaaacatgcagaggcaaagaaatgggagtaagaaactttacaactcagggcatgagaatgtgtatgaccagccttgctgactgagaaaagtacaagtttgacattttaatgattttgattaaaagaagctttctttggcttctgaggagctggttttaggtgtgatgttagtttctgtttttttctactgggtttggaagatacatgcagctgccaatagagtatgttcttccaacttctcggccataataatgaacctagaacttactgtgtttgcctttgtgcattatcttccttggtgctc

SEQ ID NO: 7692 - DNA, 1191 bp, Homo sapiens
caccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggccccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaaaatcagttttatgcactttattttgttttgattttcattttttattaagaaaaaattttattttacagaatttaccttctctgt

SEQ ID NO: 7693 - DNA, 2124 bp, Homo sapiens
agtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacattt

SEQ ID NO: 7694 - DNA, 1148 bp, Homo sapiens
aaatgttcttccctctgtcttcttggtctttttgaaatacatttaaatagcctttttccttttttgttgattctaaaatcctcacgtttttggagtttgaacttgagcttgtctccaagttctaggggtattctctttcatgacctaggacatagtgcagggtcagtgctaagtgagattctggaagcagagtcttcagaattccaggtatattttagttttgctgctggttcaaacggctcatctcagtctcgttttgcctctacagaaagtacctttttcttcctgaattttgggtggaagagggtatacccaccctctggggccgtcatcaggactaagtggctgatgatcattttccatatgttggttccacactgacttcaaaagggtatgaacagcttgcgtctgggaggctcattaagtttcctgggctctctggaccacctccagtttaatgagttcatacagtggactaaagagcctcaaagattatgaaatagaaatgccctttctctaagcatatttaggggaggacacactgactgttccctttcctgtttaaatatgttatatttgtttgcgagatggaagaggaaagtagaatgaaaagaaattaaaatctctgtagacttgagctatttgcatacataggacaccatgaaaaggacatttagtggattcagaactcaacgtgggtggggaacgaaacagagggtaaaaagactggctttgcaaaataaataacagtgtcacttggaagtggtgatctgagtgaagatatggaaataatgtggtaaagactaaaccagaagtagatataccagaagaagacataatcaaaacaacacagagatcagaactacagagatgtagatgttaatgggagaacaaagtagagttatatggtgacagtcagtcacaactgtggagggaggaaggccaggccacaaggacgatggatttaaatgccattttattaaaattttaattactgtccacttgcattgcctgagattttgggatgaacatatttgtgtctgtgcatgtatgaaaccaaccaacggtcccatagatagtttttttgggtaaacatagaaattgacccttctggtcttaaagcttgaaacttacatttttttaatatg

SEQ ID NO: 7695 - DNA, 1184 bp, Homo sapiens
ttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggc

SEQ ID NO: 7696 - DNA, 1156 bp, Homo sapiens
aggcaaatcagagtgagtaccaataaatctgcccctcccttcttacttgtctccccagccccagctctcagtctgccaagtgatcagagattttggcagaaaccaaagtgaaccattctagtctcaacccatactctgtgtatggtgggttttttccctaattctactttttaacttttttctgattataaacattattatataggcatgttgttaaaaaacagaaatatccaaagcagaaagtgaagtacttaaaataatggtatttcaattgtgaaaaaaattaacaataatcaaaaatagtttgaaaggctgaatgaaagtccatgtttaataaatggtcattacagtaactctgagccagccacagtgctggagcagttaatctgctcaagtcatttagtcctcccttcagccctgtgagctaggctgatgagcaaacagaagctcagaggttagataagtggtagcacctgtattcaagtcaagtccatttatctctaaaacaagagctcttaccactattgctgaagctacacatttcctaaggctcaggccatgatttcttctctgctttatgtcacttctcattctgccctaacatctggagggctgggtgttcaggtagaagcctggatacgctgccactgtgaattagtaccaagtgcaggcagcacagagcaatgggtaaggcacatgactcgctgtgggtctcgggctttgtttatctgtctttctcagagacttgctgcatagaccaatgcattgcatgtgtgcagtcctcagagccgcctgtcgtacaataaatgcttggtaaacacgggcggcatgagcattgagctgagctgttccttccacagtctctctgccacgcctggtcgatctggactggagagtggatatcaaaacctcctcagacagcatcagccgcatggccgtccccacctgcctgctccagatgaaggtacattcactatcatgccattagaaagaagaggcagcacccctatggccgtctaaaacactagtctccaaggtttgggatctctaacccatatatttttttaaattaccatcccctttatcctcctttgtttagttacaacgtgtatgtgtactactgcagtaacatactatggacatattaaaacaataa

SEQ ID NO: 7697 - DNA, 2205 bp, Homo sapiens
aactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactg

SEQ ID NO: 7698 - DNA, 2233 bp, Homo sapiens
gtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtaggatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaattttgttttgtgtcttgatgtgttataattatggtaacttcagattcttggatagttattaacatttattgattgcttctactgtgccaataggctgaaaatataaagatggacaagaactgctctctgccttcaaggagttcagtcttttttttttttttttttttttttgagacggagtctcgccctgtctcccaggctggagtgcagtggtacaatctcggctcactgcaagctccgcctcccaggttcatgccattctcctgcctcagtctcctgagtagctgggactacaggcgcccgccaccacgcccagctaattttttgtatttttagtagagacaggatttcaccgtgttagccaggatggtctcaatctcctgaccacgtgatccacccgccttgg

SEQ ID NO: 7699 - DNA, 1871 bp, Homo sapiens
cccgaaccaatggatacctgatccatgctcttatggtaggtagattttttgaatcacaaatcaatactttctggcttggggtttctttcccattgagttacaggatagtatgtaatagattagcacatatacattgtccagccatagtaacaagatatctatatcttgttataattataatggtcgtatacccaagaactttaaaatctacctataaataaaaacaacactataataaaacattaaatcatatgcttcaatttagcccaaattgtaggctataattacatatctctctcattctgtttccctagggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacattgtttgcccttttttcctctcatttcattgtagaaatggtgacaccacaatgacctggacagtattttatctgctttcac

SEQ ID NO: 7700 - DNA, 1350 bp, Homo sapiens
taaacttcagtaaactgaagctcagatccaagtagttttttttctttccatcctttgccttctcttagctggcagagatggggttaagaattgttggcagctaatccaccttggtttgaggccctctcacactgagctggaggaatgactggaatttgagggggaggggaaaagatactctgacctttgcaggcccgtggcctccaagcagcatctcctgttcacgttctcccactgaactaatagtccaagtacccccagttcaccgcttttttccacacctgtcaacctttttaagaacctgggagcagactgtggctacttgagctttttttgttgatgttgaacattatgtattttgctgttatctctcaacctcttgaacatactatcttttctccctgcccccatccttctcattctgctcaaacccctcctccccacctcctctccaaatcccacaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatg

SEQ ID NO: 7701 - DNA, 1168 bp, Homo sapiens
tgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgt

SEQ ID NO: 7702 - DNA, 2576 bp, Homo sapiens
gagacggccacaccagcgctccgggctaggggggcagcgctgggacacatcccctcctctgaccctgtggccttgctggactctctcccacagtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgttt

SEQ ID NO: 7703 - DNA, 1153 bp, Homo sapiens
tgggttcaccagaaggcagtggctagcagctgaggtgtcaggacggcgtcctgggccctccaggagccgggtgatgaaaggttaggccctggcttccctggcagggtagggttggcctcctgtcctgatggctggcacacaccgaagcattaaccgggagtctcttgtgtgccgggtgtgggactgccgtcacagttaccacccgccgctgtctcctttcaccatggggcctgtgtgtggggaggagaaaggcgtatccactcctttttgtggatgaggaactaaagccagggggcgtaggagggtagtttggcctggaaatgacatcacactcactaaagaccgccaatagcaacttttgcagttttttttcccaatgcgacatggtatactgcctccctagttgatccggtctacagccacattattcacagaccccacagtttgaaactgtgttctgatatttgttcgggtgctttattttaagacaccaggaggctcaaaaatgggaggtgacccggggacatccccgcactctgcctctggcagccctggctggggcaggagggtgagatttgcctggggccacagggcactgagacagcagggtcccctgctagagggcccagtggcttctgaccctgtctgtagatggggatggcttttctgccttgccagagggtgggtgcaagtgggaatgagattctggaagtggtccgaggtaggaagtggcacgaccgttattcaccttggttggcattgaaaccccgggagcttggtttcctcatttgcagcgtggccgtcaatagcgcccatcttgcagggcagctgtgattagagaagccagggccaccccggagccagcctctgaggcttcacctcaccccgtttacactgctgtctcctctgcatagatttggctgactgaggacgcgacaggtactcagcttctttctgcatctcagttgcccagcacaggggctggcacgcagtaggtgctcccaacctggtccaagatgttgctggcggtgggggagtggggggctggggaggatcatgggcagacctggggtgccgggaggggctggtggggggctgatggccgggagggcaaggcctgagcagggaatctagaccaccttagtgtccccgt

SEQ ID NO: 7704 - DNA, 1998 bp, Homo sapiens
aagcaccaggtcccacctggcccagccccagccttgggacttcctctcccctcacacacgcaaactgctgtgtctggggagttttcactgaacattgcagagactaagaagggttgagggcagagatggctagcaagacagggcttggtgagggcagaaacagtaggttgagatcctttcttctagccaacagttgccttacaccttacattgggtaatgggtagggaggagcaggctaaggctcccgctcatttgaaaaccaggaagagagaaccagtgtcttcctgagcacctggtcagttggagctactctttttcctctcaagagatcatggccaaaatgagctaaaatcttcagctagaaggggaaaagcttatgggccagtgccagtgcctaccctgtagttcctgagaaagctgagagcaggtgacccacttctggcctagcagaatgagctgctatgcacagcatgcagctgcaggggtcacttcctgagctggccaccagacctcggaaaagctaacctctcaggtggtcttgaagttaggttagggcatccctaaaactctgggtgcttgtggcttctgctgaatttagccatgccagggctgtggcagacactctgtaggccacactgccatgggacagggaataatttgggtgatacaccactgcaatttacacggggtctcttctcagcttggatgctccctgggaggcccagtgcttctgtcctgtgaattctgcatgtgattacccatgatttctgtcataggcatttcccactcttctgcttgcttgagaaggacttggactgatgggacactcagggtctagcccagggagcatatgcttggctaacctaatctccccttgatgtgtatacagaactgtggaaaagcagttggtggatcccaaatgttgttacttcagacaagacagagccctttaactcagcctctggcttaggagtgatgactacaggcttagaatgaagtgtgtctctggggctgagacttggcataactgggctggctgattagtgactttctttggctcgtagggttggtgggaagtgagatcaaccttgaggcccaggtttgtggccaactgtgccaaggtgatacctggcagagcctgggagccagagcccttatgattaatatgatctgcttttccttcatggaggacaaagaaaaaatccactgccatctagtatctgtgaaacatgaggacagcgcagtcaagtctgtaactcttgccatgtcagaatccccaagttttgcctgcctggttgaatatgagagtccaggcatcagaaacagcagccttatttaatttaatttttctaatgactggcctatgacaccttgtgatgctaggcacatcctcatttccccatcctcacttgggactgagagcaggctcaagttccagggtccctggatggcaaggttcagtgctgggccctggaatctatggcacttgggggtctctgacctcagcctctgccacatgtttccaagttgagttgttttgctgaggtggtcctccccttgagttgcttatgccaaccctttaatttaggaaaagtaccttgtaattacttaaggtaatgtttaaatgttttccattcatttggaggtggtgccaacaggggggaaagcatgcagaaggctggaaacaatagctgagaccctactgtgggcccacagccctggcccagccggcactgaggggctggtgccatgttacttgatcacctggagcctgatgggacccaggaggtggcctgaggggttgaagtataacttccctcttctggatcccccctttcattttccttctaccccctctaggaatgggagttctagacctaggtctgcttttggctttcagtctgggttgatttccaagtcgaattcatgctttttcttggcccataggtccaattttggcagaaggcattggacttgtgccccctccctgcttcaag

SEQ ID NO: 7705 - DNA, 1207 bp, Homo sapiens
gagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctggactgcagtggatgtatctgcatgggcccctcccgtccccgtctcgctcccagcccaggaaagccaagcctttgtcacacatggtatctttatgagggccttgggtcataggtgtgcatcatagtaatactcggcaaggtcgggcccgtcccgcttgcgctgctgggccctagacaggaggggtcgaggccctcgcggccttgggtgcttggggaggatgccatagtctaaagagagaaaagagggcatgggtggtagggggcagctggctctgatggaactgaagtcacccttgaacagatgtggtttgggatgacaagcccctgaaggctggacttggggcacctcttaggggcgtctccactgtcagggatgggtaggggaaggggaca

SEQ ID NO: 7706 - DNA, 1576 bp, Homo sapiens
tcttgtctcctgttgtgaagcccaaatggaagcgtggatggtatcagggccctacccgtggtcttctcagattctgctagagcaaaaggctggtgcctaaataagatcccttcctttggtgctgcttttggtctttcagccaccagcattatgagtgcctgggggacacctccgagggaactggccagcggagctctgtggtgcgcacgcaccctggccgtgacaggagggtgcgggagtacaggctggctgcatcagcccttggtgcttagaacagaggaggagtgacatgttttgagggtacgtctctgagacagagccccagcgtggccttcgctctgtcttgcctttggggagaggtctgaagctcccactcctttctctgcctgttggctccaggcaccagaaatttactccactccacccacccacaagcctcctgggtgaccctgggctagaattgctgcgcttgcctcggcttggccggttgtggcctctccttgagaaaaccagggttgtgaaagactcagaccattctctcatcttgccttgtcagaagtaaattgtgtcagatttgtgctctcgctggagacctttgccccttgcgtgcccctggccgatgggagggcggtggaggctctgtaccctggccctgctggagcatctcccccaagcccactccaggccctgggaatggccagagtctaggagaggtagaaacgatcctatcagcttctctcccacccaattaggcccagagagacaaagacagatctgaaagcaaatgcaacagagaagagacacttcttagagtaaaatgtgtctcatctctatcagccatcgcctttcatcttcccaggggcctcagaagaaggaattaagttaggctgaacaggcctcagagttaggccctggctgcttgattggctgagggggaaagagttcccttttctcattcagaaaccaaggtgctgtgtctagtcagggagccttggagatgcctggactagttggaggaatcgttggcagaggatcagagaccagcagcaggctgtctgccctgtctagagctcttcccctcaacttgtctgggcccatctgggggttgccacacaacacctaacttaccttttcctgaaagaagttgggaaaccatcatcactagaggcctttgctcagagaggagctgccttaggagtcttgggtcggaggacggggctaggaattgaccagggctttgcctgccgccctcagcagtgtcgggtacattctgacctcgcctgcagctgggctgtggattcttcctgacattcagatgtgagctgttttgggagtcagctagtatggagtacgagatgcaacccagcccccaaacctacattctgcactcaaattccaaaacactgctttactgtaaagaagaggcccctggcacccaatctccctgtccttcactgtcccctcagacctgggcggggaggggggggggcctgtgaccacctgagacatacgctcgtgacactgccccaccccagccacctccacttgcttcctcctccttccctccgctgctctt

SEQ ID NO: 7707 - DNA, 1149 bp, Homo sapiens
attcatttaatattgtcttcaaaccttatactgcctaccactctatccatggccctaacatcctttcacatctaagatgagagagtgattagcacagtgcttgcaaagcagcaggcaaattgatatttgtggatgactcaaaggatgttctgagaaccttttctaaactgctttaaatttgtgtgctaataacacagatggaaacctagctgtgagtaagttaccaatctttaaaacaaagacgactagaatggtttgtatttgtagttcatattcttgtcctctgggattcagtaatctttttagcctctctccacagtggtacatgtatattcctgggtagcaggctgattgctactgatggtactgaaatgttttgataggagcaaaactgtgctgccatcctccttacgagcccagtgttcagaggtgacctgtttgcacatgggcctgtggtgtatcacttttttatacaagagcagtagaataaggtctgactcgagttgattgaagtggtagttttaggttctgataagaggacctattgctggtgagggaggttgaaattgcagaatgagtttgcagcatgaggcaggtctgcccagcagcaggttgatttgcaccgtgagacaagcagcacacataaacagatggcccaacaatgagtcagaacaacagatcctgaacaggtagattggcttttgtctgattcttaacgtggttatagagagtggaattttaatttgtctgccacttttaaggctgcaaaacaagcatttagtgaaagaaattctattcattgggaaatgaaaaatgttattaggcagaggagaaatctgattgtcactggatctagacattgagaaaccagcattttcaggagctgtttcacgtaggcatgggctggcttcatcttttggcatacagttattcaactgtatcattttgctgaatcctctagtatgtaacgtgcagcaagaaaatagtaaaatgatgtcctttatatttggattttaagaagtatagtcctgttatttgcaagtacacttctgatatttgggttaagaaaagcatttttaaaaaggatacactagtgataagtgtcataaaaacatacagcaatgtaagtttgtaatggtattaagcaaa

SEQ ID NO: 7708 - DNA, 1170 bp, Homo sapiens
aatacattgtagtgctttgagtccttgtgattctgtttactaggacataaaatgctaattttagaagctctaaataaattttttccaattcctagcttgcttacttgggtaaaatatagcaagtaattagactggagtaatagtagtgtcctaaaaacatatcagccactggatcagacaacctctctgttctttctctacctttcccaactcccctcagcaagttttgactatgtatttttatatgaaattaatcagccaggaagtatattttcagcctctcctttgtgttagtacctggtataataatgtgtgctaatgcttatgatctttcatagggaaaaagaaataaacacacatggtagaccagggcagtacatagtgaagagttagcatgtggtatagataatgagaagagagaaagcaagaacagcttgggaacccaattgggactttgctccagaaacagaaagaatggaggcattctaagtcaggggaatcacacaagctaaggcagggatataggaatgaacacaaaataaagataagaactttgctgtatgtttaacacttttcataaaaagtgttgggccacaatcaaaaataggattaagtagttatgacaggacctggtactagaaggccttaaatgaccatactatccttgcctagaactagacttgctttgaaagcttcgatcagttcctatcttttgaatggaatactttagcatttgaagggtaaaatgaatttatattggaggaaataaggtttcattggcctgtctgctttttgtatatgtttgttttgctaaggcaatatattcagagaattgaatcagtgctttatcttgtagaaggaagtcaggcatatagttaagaaagcagatttttttttccttaaaaggaattttatttcctaattgtgaaattgtggcctgtttgcttagaaatgagaatgtttatgagtgaaagcacaggtttaatgtttaaaagagtttggataaccgttgcagaagcaaaatggatttctaacattgcttcctaatctgggttgcccgaaagagtaagagaagtcctgcatatccctgtgtgaaggttacacaggttgttacttgaaatgctgcttgtttggaaaataagatatgaaatccaaatgggggtggaaagg

SEQ ID NO: 7709 - DNA, 1191 bp, Homo sapiens
agatattctgatatggagccaaagcacttagttgctctagttctctgctttcattttgctttcttgtagaggcaatcttaacattccgaagtttgttgcttgttactgtggtgcttcagggttaagccatcgtggttgcagcttcggtttccccagcctgaacagtttgctgccctatctccctttacctggtggcctcctggtgaggtttcatgtcatagcttaaatgtcacttcctcagaggagctatccctgacactccttccactagtcaaaatcaactgtttctattattatctcacattgaaccatacttttccttcatagttattccatttagacattcagttgtgaatgactgaaaacccaaaatgaaagtaatgtaaacagggaaaacttaatttctgtctcatctaaaagttctataggtccccctagggctagggctgctgagagtggttccacgatgtcagggaacccaggttcctcctattctgttgctctgccattctcagcatgcagctttcacatcatagtccaaaatagctgctccatctggtaagaagggggagaagcaacaaagagcaagccctttattttttaaggatgtttactagaagttgcatgcaccacttccagttagatcccatgggcctgaacttagtcatgtggcccctgctaggagcaaggaagtctggaaaatgtaggtagtttattgctggtagtcatggccagataaaattcaaggactattactgagtaagaattgggaaataaatactgggaataattagcattttctattacagtagcatatctgtatctgtaggattactattttttaaatatctgtcttccttattagattgttagtttcaggaagtcagggaacgtgtttgttttatttgcttttttattcctagtataatatttagtataatatttaacatagaatattaacacagaagaggcacttatattctttaaatgaattattttatccacccgatcttttgctctgcttatattgtaatttttttatagaacggtgtgtcttgctttttatgctttttaaactaacttatgaaaatcttcttagatttttgagtgttctttgagaacatgatttttaacagctttaaatattagcataattggctatatcatgattttttaaaactattcttctct

SEQ ID NO: 7710 - DNA, 1191 bp, Homo sapiens
gcaggtgcctgtagtcccagctactctggaggctgaggcaggagaatggcgtgaacctgggaggcagagcttgcagtgagctgagattgcaccactgcactccagcctgggcgacagagcgagactccatctcaaaaaaaaaaaaaaaaattatgattctgttgttatatgtctctttctgaggacagtgtgtcctggatggttatagtctcattgaagacagaagtggtcttactcagctctgtatcctcagtatgtagtgattaacacagtgctgagcatgtagtgggtgcttagatgtttccatgaccagattaaaccctttttttggtttttcatttcttagttatttgaagtgttctttagaggaatacttgaagaattgttttgagggaaaaaaaatctctttgggaaatttcttgccctgcgttagagaatcagatattcttttactaacataatttatttaacataaatattatatttattccaaatgtaatgatccaaaacattttatgatctttacagctgcagtgagaagaggagtttgttactttaaacagaggctgaagaaactatagaattagcagagaaagtggagaaggtagaggatggagttgcagactctacaggaggctcttaaagtggaaattcaggttcaccaggtaagttgtattattggcttctcccacactgttgttaagtaatggctaagattagtaaacaagtccatctctggtgtttagtatagtttttaataatctttaagacaattttgtccaagagtcatgtcgtttgccttttaccactactcgacaaagtcatagatactgcttttaagaacttaaagtattcctgacttcctttctagagaaaagaactgaaaagatttttttcatataccaaaggtgttaacaaaaaagaaagaaatcttttttctgctttttggttcatctgaaggactttattcatgtgatttaacttgcatgttttaaataacaacatgtctaactcaactaccatatgtactaaagtttttacagatcatatgactcagctttatgcgttgattccaatcttaaagaaaatgtgattatcttcacagatgtttaaatttcagatttcacaattcttatattttacaaaaagctatctttatataattacataattaaaatttgttatgtaaac

SEQ ID NO: 7711 - DNA, 1135 bp, Homo sapiens
tagttaatccttgcatttactacctttttattctacttgcctttctctcattaaaccttttaaaataaataatcaagatcctatagctctttactttgacatgggatggaatcttagagaagcgaccttaacccatttataccagaggttgcaaattttttttgtgaaaaatcagactttggcaatgaacttgagcagtaggatataaataactcccacaagcttagtgttccaataatggaacactaggtataaatgggttaagggccttctcctccagtattttaccttgtgtggcagtttcttctagatccctgacaggttgttattcaggtacatattgaataccacatttaaaaaaaatgtagctcattttctataatgtattctgaggaattctacttccacaaaaaataagtattattgaggtggggtgggggtgggaaaaggcttctgtggtcaagtaatttgggaaatgctgcattaaacaaagttaaacaggtttctttactgcaggacttctcagaacctttaatatgctaatgtgcattgtgaatctccaagagggggatatgatatgcagcattcttgaatacttctaatgacagggagcccactacctcataaggtaacccattccttttttgtacgactcttatccttagttcttccttttccttatattgatctgaaatctatctcccataacttccacttctattaagtatttattggttatgctgagactaccacacccacttgcattatcctttgtgtggtatatatttgtaagattctggccaggcttgtctggacagtttttttttaaatagtcattaaatattaataacattctggtaaatgtgacaactagttctaaaaccttggcctcattgtcactatgctctcataccttactccccaacctcctccattttcaatttctgtgtattttaaaatttactcagttttccttttgttggatgtggttgggataatctagtagacgtgcctgatttttgtaaagaaagttaggaaatagaagaatgtgtatattcagacagcctggaccccaggaagcagaggtagaaactgtatattgggctgagcactgatgatggtagggaggggtcca

SEQ ID NO: 7712 - DNA, 1155 bp, Homo sapiens
cctctgaagcccattcatggggatcccttaggtttaaaggatttcatgatttgtctttttttgggacggagactcactctgtcgccaggctggagtgtagtggcgcgatctcagttcactgcagtctctgcctcccgggttcaagtgattctcctgtcacagcctcccgagtagctgagattacaggtgcacaccaccatacccagctaattttttttttgtatttttagtagagacttctacgaaataattattattcaccatgttggccaggacggtctcgatctcctgatctcgtgatccacccactttggcctcccagagtgcaggcatgagccactgtgcacggccaggatttcatgttttaagatggcttatgtgatttttctttaaaactttatgtgcagacttttccaaaaatatttcgctagtgtttattgtagtttgttttttagaagagtaactcctgcagcgggttaagagaaagtgaggtctagtggaaaatgaactcagccaaggaatctcgggcccataagctcttctccagcttcactatcagctagctgagtgacctttggggaaatcacttaacttttccgggtttgattttctatgcgatttctgcagtccctacaaatagtcttatgagcagtttcatgacatcatgatttcaggatatcatggcaaaattctttatcagttcaggattggccctgctcctcatttttggagaaaatgccttggagataagatatatgtacattgtgctgccttttgttgaatatgacttttcagcagcatttattaatactttctcaaatgctgtataagttaaaatcccagtcccatcctcatcactttgaatttcaacatattttatatattgtgggtataagcctgtgttgattatacgtaatataattatcacctccgattctgtggtttaccttttcactttcttaatggtgtttttttgatgagcagaagttcttaattttaattttgtccaatttatcagtcttttcctttttactatattttaaaatggtaatattttacttcctaatcaacaacttggatgaaaacagttccagaaagtcattcatttaacaaataatgctgctggaaatcgatgcataagaaattatccccagc

SEQ ID NO: 7713 - DNA, 1124 bp, Homo sapiens
cttttttttttttttcccctgaccacgttcgcgatggtgggtagcagcaaggtggccctggtaggggaggggttggtatcgagattgggcaccggaggagaacgccttctttcaactttgtctgtggcttgcacccccggagaaggccacaggccggttgtcgggtgcagatgtgccgagagtgatttctaagtagttgagttgttgtgatgagggtacgactgctaatggtcggcaggttttgttttcattggtgaatctggtgtcatcatattccggtcatatgttgaaatattctttgtttaggtctggaagtagaggatctcactctgcacgtccacattgtgttgtttttaaaatgatgtctctgggagtctggatttctagaatttcaaatctgagtgaaggtccgggcatgtgtgggcctcatcacctggccttgacagtgaactttgtggctgtgtttcagatttcaaagatttgccccatagctggggaaggagttgtgcatttttgctaatagtcggtgtcaggaatgtagatgctcgagctgggaaagttagagagggaagaacatttatatataaataatggatagttgaatattagaatcagattaatttgggctgatgaaagttttttttttttaaagcagttgtgcactctgggaaggaagtcttttcacaggttcacttgatagggattctttaaggcgaggggctggaattatctcctttttgagcgagttctcaccaacatctgtagctttattgagggcctggtaagggtactgaaattgaggctaaaccatgtaagcgtacttttcagtgtttatgatatttgtttacatctggtgttcactctaagcaatagaaataaataggtcagctttgcttttggtctttgaagactggccccctccttccttttttaagtttcacaatttatttggtttacagcattgttggaaactgttactacatttttactggaaatactattattcattttaattttggtaagttccttcttattctcttcttctgtctttacttgtttatggaatcggtgttgtgggcttaaaactagtttattttagggggtcattaaaaatgtctgaaaaa

SEQ ID NO: 7714 - DNA, 1327 bp, Homo sapiens
caagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcaggtgaggaggctgaggatgcccagggctgctgtgaccaggactaggactggaaacttgaaggttttctgatcccaagtggaaataggaagctggggatgtcccatgtccacatcacaatggctgccccatcccctgcttccgagtcagctgattggaaaccactagggggcagaatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatatataaaagccccttcccaaggagtttgctgtggaaatgtgtttgggagtgggaaggtggggagaaagaccaggctgtagggactggtgggtttcagggggcttggtggtgggtgctctccagagctcatggaaaaagcagaacaattacaaacatttcttccagggcccctgaaagggtgctccccatcaagtcacctaagcctttcggtcctcatctccctcagggaccagggctggggaagggaacctggctgactcactggaaccaccacacccatctcagcctcacccagtcaaaggtcttttgatacaacccacagccaatcaggaaggttctacccatgggggagagcagatgcgagggctgcgtgcctacctcactgcccacctccccccttcccactgtcatggaaacccgagt

SEQ ID NO: 7715 - DNA, 1196 bp, Homo sapiens
cttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggtaagcagtcgctttcctatcttctgcatcccttgcttttctccttgtatcatttccttgagtcctatagatgttgtggctgtatctggagtgtctgggacccacgcatctgcttctgatctcgccattgcattttcttggaaaatcttgctctggtggcagagataggatagggcctagcagtatgagtcagttggctgcgctagctctatttcggctaagctcaaggttctggctttagccttgaaaggagagtgtagattaggttagagaggcatgaggagatggaaccattgactttctctgcctgctttttgaccttgtcgagacattgtatgtgcaggactacttattgtagtagtcccagagtgcctaggaataagtaaaagagaaccctgcatggtagagattagtatattggctcttcgctgattgtattgctttggacaac

SEQ ID NO: 7716 - DNA, 1517 bp, Homo sapiens
cacgccattgcactccagcccgggagacagcgcccctctgtctcaaaaaaaaaaaaaaaaaattcctctgaggaccaatataggttacataggcaatttgtctgtgttttttgttgttgttttttgcaatggagtttcactcttgttgcccaggctggaggacagtggcatgatctcggcacactgcaacaacctccccctcctgagttcaagcaattctcctgcctcagcctcccaagtagctgggattacaggcgcccgccaccacgcctggctaagtttttgtatttttagtggagatgaggtttcaccgagttggccaggctggtctccaactcctgacctcaggtgatccacccgccctggcctcccaaagtgctgggattacaggcgtgagccaccgcgccaggcctggcaatctctcttatcctggtatttttttgtatgcccttggtcataagagaagggatgagaatgtgaattaccactgcttagaaaaacaactcaattgggctgggcgcggttgctcacacctgaaatcccagcaccttgggaggctgaggcaggcggatcacctgagttcgggagtttgagactagcttgggcaacatggagaaaccctgtctctaccaaaaatacaaaaatacctgggcgtggtggcgcatgtctgtaatcccagctactcgggaggctgagacaagagaatcgcttgaactggggaggcagaggttgctgtgagccgagatcatgccattgcattccagcctgggcaacaagagtgaaactccatctcaagaaaaagaaaaacaactcaattaacgtgcatggttgacttaacagggtctcctcagtaaaagtaaaggtaaatcaagaattcatagaagtcataacttatagaaacctcctgtggagcagaaaaataaaatgaaagaagtaataacttagtattgctgttttggaaaatgctgctttcacttttgattcatacatgtgaaagaaatagtaaagaaatagttaagaatcattttacatttttttctttttttttttgatacggagtcttgctctgttgcccaggctggagtgtagtggtgtgatcttggctcgctgcaacctctgcctcccaggttcaagcgattctcctgcctcagcctcctgagtaactgggattacaggtgcgtgccaccacgcccggctaatttttgtatttttagcagagactggatttctccatgttggtcaggctggtctccaactcctgacctcgtgatacacccaccttggcctcccaaagtgctggaattacagatgtgagccaccgcgcccagccatatttgtttattattttgagttgttgatactttctttttacatgaagtctgtagtttataaaatgatgaatttgtctacttcagagttagggggaagagttatcggtgtgtactggcagcaggctgtggattcagaactgtgaaagcttctcccaatactattcagtcttgtttctacctgtttct

SEQ ID NO: 7717 - DNA, 1133 bp, Homo sapiens
gggggcagcagtggcaatacccatgatgactttgttatgatagactttgtaagtcgccgtcaccttccttgacctttgctgtcccggggaactagacctagaagcatctactgcacttgatccagatttccttcatagggatcagatgtgctggtgtagacagaagggatggacaggtggagtctggtctggggagacattttggaggccgataaacaacaaggcattttttgtcatgcctttggttaaaattcataatgaaattcaactctaaatggagattttccactgatacccacttaggtcctattcgtggctaggcaaggagtttgaaggagtgggacataaacttaactagtggagaggaatattatcaccagcattagaagtgaacagtctgggagagaaaagtgtaaagatttctctccctaagataagcctgaaagaaccttttgataattgctagaaggaaagacttgttcatagcttatctcctctgtggttcaaggcaagctaaactgactctgtcttgtttttgaagaaaccagctttttctaaagatgacattcttccgatggacctggggaccttctatcgggagtttcagaacccacctcagctgagcagcctctccatagatattggagcacagtccatggctgaagacttggtatggaaacgtcttcctctaccacagtgcatccttatttgatggtcattcctttgccaaaggcctaggaggcctaccaccttctatcttccctgtaataggaaagagacataattagaaaattatcttttgatcactcttgagattggcattgtgcccagcagtcattatctggaatttgcttgagcttggttccttctttctctgcacattctcagcattacttacatgctcctgttgttctgtgcctgacgtcttctccttgcagatgccactaggccaagttgctctaacagccattgcattagctatttagctttccaggcagatgccagtggtactgggcagaggagattgtgaggtcctgagtatctgtgttcttgctctttcctcagagagctcactccgtcatctagcagttctcacacttgaccagatgtcctgatactgattataatgaccc

SEQ ID NO: 7718 - DNA, 2577 bp, Homo sapiens
catgtttaatttctgaatcatcttgctcttgtggtccttttctcttttgttaagtgtgtggcccacttggactcccaaggccgttccattaatcctccagcccctgcaaagccctgatgcatatacccctccctaccctgtgcctacgcagctgccctgcgttctcccacttgctcggcccagctagggctgagcttcgtcttgcttgctgcctcccctcttcgggactgggctggctgcctcctcaaggccctgcctgaataaacggctcttccctctctttccggtacaggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggtt

SEQ ID NO: 7719 - DNA, 2832 bp, Homo sapiens
gctgcccgaggagaactaccaggtgcttcgtttcctgactgctttcctggtgcaggtgagaccttggacttggcctctggggtgaagggagggggaaggaggagctgccgcctcctctgcgccctggtcattgttgctgggagtgggaggcagcatctgtggcttcctgctgcagtccctgattccctccacagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcacccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaactgctcatctggatgttggggaaatgagttgggtgtggaagttggaaactggatgggaagtgtggtgcggtggaggaagaggaacagatggggcctcaggaagtcccctccccagtccgtctgccgcttcctcatcttgtgcactcgagtggtgatgagggcagcttcctgaccagcttctaggcatggaggtgtccacggccaccttcccgttgtttgtacccccagcattccagcaggccaccatgtgctgcatcctatgaccagggcctctcctgtttcccaactggaaggtaccggaagtttgaagggatcttagatttatctaaggcaagcagggggaagaaaagtggtgtggactgtgatggacaatggtgtgggatctggagtcacacgagagtttgagtcctcgttccctcacgtgccagctctcaccgctaacagtcatcatcactggctcaccacccctgtggctgctgcttcatcagaaga

SEQ ID NO: 7720 - DNA, 1516 bp, Homo sapiens
gggaagaagtggggccatctgtctacttggaaaggctaaagatcctccgacagcgatgtggtctggacaacacaaaggtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaaggatgagaaagtgagctgagtattcacctctggaataaattccacaggacctccctccacagt

SEQ ID NO: 7721 - DNA, 1121 bp, Homo sapiens
acagatttcatttattttggggaaaaagatatctacagccctatgatatttggtctcttttgtgaaagagaccaaatgaacatatttataacattgtaatactgttattacactgaattagtatcagatattttgtccccttgcattagatttggttaagcaacatgaactactttactctcaggaacgaaggaaacccaagagagaatttctaccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaaggtgagtaagaatcgcaactggtctctgagggagcttgagagaaaatcatggaaatggcagtgctatcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgagggacatgaggctacaccggaagtgatcttatctaaggtgtaggtcaccaggatatgctttccgaaggtccaaggtgaaggctcatggactggttgaatcagtctcctgctgtggtgcagtaaccatttccaccttgaaattttaaaatctaaactaagtataaccatgtgttttttggtccccaagaaagatgc

SEQ ID NO: 7722 - DNA, 1196 bp, Homo sapiens
aaaaaaaacaaaaaatttcacaattagaagcacaccgattaattttgcctattactagaggcttgggggagtgtggtgattttgttttttctttaatactctgaatttttacaaatataacatagccgggcgcggtggctcacgcctgtaatcccagcacttcaggaggccaaggcaggtggatcacgaagtcaggagatcgagaccatcctggctaacacggtgaaaccccatctctactaaaaaaaaaaaatacaaaaattagcccagcgtggtggtgggtgcctgtagtcccagctactcgggagactgaggcaggagaatggcatgaaccggggaggcagagcttgcagtaagccaagatcacgccactggcactccagcctgggcgacagaggagactccgtctcaaaaaaaaaatacaacataattgaatatttatcagaatatgccacccacatttctttactctctatattgagttttacacctccctgacacaagtatgtctggatagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgaggtatatctgtactctcagccaatagagcctggggcatcctcgcttttgtttacacttagaaaccataatgtccgtaagtcaacttcctaggcaacctaacaatcataatcaacttcctaggcacacttaaagttatagctacatcagttataactatatcagttaaaactttaagtgtgcctaggaagttgatttattactcttcttcatcatggaccaaaggtattttagcctgagaccatagctaaaactagtaaatacttagttagccagccaatatcatgcattttctataataggactgtaaagtttgtcagttacatttttcttgtacatttcaggtacattttattctttctcagctaccaatgacaatgaaaaatagagtcacaaaccttacacttaccaagtggtgacttaaaaggcttaaacaatgtttattttcttaactgaatgtcaggtagtccaggacaattcctgatccatgacct

SEQ ID NO: 7723 - DNA, 1141 bp, Homo sapiens
tcccagctgacctcagtttctgtacttttatttcctctcccttttttactgattatatcacggtaccttccctacttatccctatttccctattctttcaaaacatagtaatgcatgggagaatcattgctacttaggaaatgcctcacttaatcattattttccttatcgactaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcaggtgaagcaaacagtttaaactgagatgtgaatctctgcagcagtagcctatagaagaaatagtttatagatgaacaaataaatttctccagtgcctatgtagttgattccaacctcctgatttagactgtgagagtgatgagttgcacactggtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccagagtaaggttttagtccttcatatatgccaagggaaatttctctagtaaggataagtctctgtcccaaatatgtgttgtctcattaatctagcctttctcccccatcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatgtgagtgacttctctgaacactgtcagcatgtcgtgaaaagaattgcaagatctcctaggtgttaggtttcctgtcctctcaactgtagctaagtttttactactttttagtcaactcaacctatcaatgtgtcctagaatccagatagacccttgaggtgtctctgattaggctgttttaatggaaatcaagttttctttt

SEQ ID NO: 7724 - DNA, 1141 bp, Homo sapiens; identical to SEQ ID NO: 7723

SEQ ID NO: 7725 - DNA, 1187 bp, Homo sapiens
cttaaaagccaacaagttctctaaaatctctgaagttctgtgttgcatgtgtgtataagagggttgtagtgtttttgtaggcagccctagtagtaattctcagttatgcagtcagtatagtaatttattgtgtattttagggtgtgtattcagtactaaatgcaaataatcataagaggaggaaaatttaaaaatcagatttttcaattaataaactttctgtgcaatattacttgttagtattttggaacactgagtagctttttttccctctcttcactgtcagttaagtaattggtaacaattaaaggatacaaattattttgcatatttgtttaaaatcctgattttactttagttgtgtttccagctgtccctaaccatgtcatatctgttacatgctgttaatacaagtaaataaataaatgtccttggcttgctcttagctttatgatactgatccttgttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttagtgacacagaagtcttattcctctagttttcccaattttttcccccaaactttaagcttactaattaaacattagtttttatcttctcaagtaaaatcttttttgatactgcattttttttgagatggagtttcactctgtcgcccaggctggaatgcaatggtgcaatctcggctcactgcaaccctcccgggttcaagtgattctcctgcttcagcctcccgcatagctgggattacaggcacctgccaccacgcctgcctaatttttgaattttaatagagacaggatttcgccacgttggccaggcttgtctcgaactcctgacctcaggtgatctgcctgcctcggcctcccaaagtgctgggattacaggtgtgagccaccatgcccggccctttgatactgcatttttatttttaccttaaaaaatactctattgcctagtgatgaaaattcatcttagtcaaaaatattcggtcagacacagaggctcacacctgcaatcccagcactttgggaggcc

SEQ ID NO: 7726 - DNA, 1120 bp, Homo sapiens
ccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttagtaacatgaaaaagctttggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaata

SEQ ID NO: 7727 - DNA, 1151 bp, Homo sapiens
cctgccaggcctcatggacatgcaggctgtggaccgggcacagccactaggtgagagtcagagggctggggctgtgagtcagagcctctggctttctggggccatctcaacatcagagatatatccagagcacagagctcctttacagccagaaagacggtgacctgtttaagctcccttccagattgggctgtgttctctctgggtatggctggtactacagctgtcaccttcaaaggactcctggagatcctcctgcagaccctccttctacctcaccctgccaggcactgaatcctgtcacttagaacagcaaagagccagccacaaacaactgggacctttgtaagattcagatgatgttccaggctaggtgtgaatacttgtgcttctcatcaccaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggtatgagcaacactgaaacctccagaagacacagatttgcttctggtcgcccatgggtgaggttgtgttctgaccactaaatggatgagtgatttggcactttggatagtgagttttaatcctgacttgttcactttgtagtgttgtcacttacagcagagtttcaaactttcatttgtttagagattatatggaagcctagtatgtaaaacaaacaacaacaacaaaaaaaacaggtaaagtcaggggacctggagactttcacatctaccattgtgccctgagggagctccaagaatcccctaggacttactgatgagtaggccatataaccagtatctgtattgcagtaaaggagccccaatcaaatgccaagtcttatggtggtttacaaagctgttgttttttattttttcgttgttttatttttagtctttaaatttgt

SEQ ID NO: 7728 - DNA, 1151 bp, Homo sapiens
aaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaa

SEQ ID NO: 7729 - DNA, 1226 bp, Homo sapiens
tttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtaga

SEQ ID NO: 7730 - DNA, 1118 bp, Homo sapiens
ttagtagagacgaggtttcaccttgttagccagaatggtcttgatttcctgaccttgtgatccgcccaccttggcctcccaaagtgctgggattataggtatgagccaccacgcccggcctcagcctcacttttcttatttgggacttggggatgatagcactgatttcacagggtcgtggtaaggattagatgtgacagtgtcaagcgcagtgctgggcacaggatgaggacagtcagtccctggagtcccagatgcagatttctagaaggccagagctcaagagaccctagaaataacctgttataacctgcattaacttcctcccttcatcccccacatcttgtactgagaagaaaacaaggcgcattgagtaagggacttgcctctgatcacagggcaacttgactttgttgcttgacggggccaggggaggatatttggcccctctgcccattccgcataagccactgagcctgtggtatctgtcctgtccccagtcctgacgtgaactacgaggagctggcccgctgcacagatgacttcaatggggcccagtgcaaggctgtgtgtgtggaggcggtgagtggtcagctggggtgggtgcgttgctttgtgccttcttgccccctccctggacaggatgggggcatttggctggtggagacggctgagggaagaggcctgagcctcagggagccagggaaggcattcaggcgttcagacctagactctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgccgctgcttgtctgccttccctgggctctggctggaggagtgggggcgtgtgtgggaggcaccttccccaggtgctgacgcctggaaacccggagacagccgtgggccccataccactggtcaggatgaggctttctggggctgtgtgtggtgctgcagctgctgcctgggccttcaggcccctcagagcc

SEQ ID NO: 7731 - DNA, 3148 bp, Homo sapiens
aggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttg

SEQ ID NO: 7732 - DNA, 1176 bp, Homo sapiens
cttaaagttaaaaaccactgatttctttaaaattaacgtattggaaatgctctccctacccctttttttgagatggggtcttactttgtcacctgggctggagtgcagtgggaatatcatggctcactgcagccccaaccacccaggctcaagtgatcccccctacctctgccactcaagtagctgggactacaggtgcacaccagcacgcccagttaatttttgtatttttttttaatagcgaccgttttgccatgttgcccaggctggtctaaaattcctgggctcaagtgatccacccgcctcagcctcccaaagtgttgggattacagtctcttctctcttgtgtctatcatgaggagaatcatttggcagtgaatgaaattagaatgtaacctgcatgtcatccaaaaggaagattttttttcttcttttcagatggaggaatttgaccctttcgttatggtcttttcacagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctctatatatatgtatctctggacatgcatctctggttatatcttgaggcttttgctgcaactaaagtgaattcctggtttcccgttttaaagatttagaaacatcttgtgtccttgcctccaagaaagaaattcctgagggaatcttaactaccagtgtctttctccatatctctttctaccagatgtagagggcatcattaaaatccttattgagtctttcctaaagagtatgataaatgtttctttcagcggacttgagagatcaagagattttttttctttttttgctttatttatttatttatttatttattttttgagacggagtctcactcactctgtcacccaggctagagtgcagtggc

SEQ ID NO: 7733 - DNA, 1146 bp, Homo sapiens
acttaggatctcagcttcccatgtgcaacttcctttttctaggatttggcagagcaagaattgggtagaaagactgactttccacctgacctgttgcatagtattgtgagactggctgactgcagtggttacagtactctcccatttataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataa

SEQ ID NO: 7734 - DNA, 1159 bp, Homo sapiens
ttgtagttagttcatagtagctcagcctttcagagaatactaatccttgttctgtagtgatagtcccagttttgtcctagatttagtcacgtctcccaattggacctctctgctgatttggattggctgatctcatctcgctagatattatttgtgttttgttttgttttgttttccaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagt

SEQ ID NO: 7735 - DNA, 1511 bp, Homo sapiens
agaccctagaaatgtggtttttgatgcctctcatctgtatctgtacttgggaccattcttgctttgtaatttttctcgtcttttgctctgccaaatatgaatatcagatagcttagcaaaatcatttttttaagctagtcaaagcaaaacaatatttaagtctcttctgcaaagcacctcgcaaatcttttgcctccctgcttacagttatgaatagtaaggtgagccactgagggtatagccgacctgcattttaaacataggaacaaaagtcactggagatcagcttcaagtacagctgtgttaacgagaatgaactaggtatgcgggctggattctggtgtttgattccttttttacttccctagaatgttttgtgacctctaattatttgacaaacatttgtactgaagagcctgtcatgttactgatcacattttttggttcttatttttattgtttcttcatgtaggggtcttgttcctcgccttctaggtgacatcctttctttgtggctgtgtaactcactggcctacctcgtcaatacctatgcactggacagtggggtaggttgtgaccttcgtgagatgtgctcaccttggctttaatctggcagctagattagcttttaaagtaagatgggccgggcgaggtggctcacacctgtaatcccagcactttgggaggccaatgtgggcggatcacctgagatcaagagttcgagaccagcctggccaacatggtgaaacctcgtctctactaaaaatacagaaaaaattagctgggcgtggtggtgcgtgcctatagtcccagctacttgggaggctgaggcaggggaattgcttgaacccaggaggcggaggttgcagtgagccaagatcgcgccactgcattccagcctgggtgacagaaggagactccatttcaaaaaataaataataaataaataaacaagatgacagtttgctacatgccagactgaacaattatatagctaaaaattatcagtcaaattttcaaatgctaatgaaatgagcatactgttcactgtagaacgatactgtttactgtagaacgatacacgttaaaagtccgtaagatgtgacagagtatacccaagagacttagccctgtgttacttcagggctttaaagagatcacttctttactgatacttaacttgagagaacctgggaaagcaggacatctttatggtgtatcgggggcttttcatctaatctggacttaagagggtgcctgtattgggctttctagaaacctcagccttttgagaatcagtcttatctagaagttgtctttcttatctcagcagttgtggggcctcttgtatgtcggcagctccatagcatgatgataaattgaacacatcacagggtatatgactaaatccatgttgtaaacctcttgagtacagagagggattttcttcaacgcatctggtagaaagctagctgtgtaaaacaaaggtagtgaattgtcccttagatata

SEQ ID NO: 7736 - DNA, 1193 bp, Homo sapiens
cataactgaagcaggtgatgactggaaaagtcaggtaagaattggctgcaatttggttgttttctttaaggtttgttgtgggtgtggtatgttcatttctattgctctttttgatatttgatctacatttgatatttaggctactctaaggacatgtattttcaaacatcatttggatttgggtcacaatagccaagcatatgaagccttaacccaaattcctgattccagcaggtaatttcatggccttttttagagaagacaatttaccaactctgtttaacctactaagatagtttgccctcatattcctttctttccttctaggcaattagattgtttacggcagttggtggtagttctttgtgaacgctcacagctacaggatcttgtagagtttccctatgtgaatctgcataatgaggtaattttacttatccagtgatggctttcaacaagtatggtggttgccatgattgctactgacttagttatctgattgcttccccttccctaggttgtgggaataattgagtcacgtgctagagctgtggaccttatgactcacaattactatgaacttctgtatgcctttcacatctatcgccacaattaccgcaagggtgagcaatgtaaccagacagtatcttgcagacagccttattagtttaatcatgttttaccaaaatattgtgtgttggacttaggtaatttttaatatgtgtttaagtacaagattagcttaaaccttgtgaagattaccttgaagataggcccttgcttccattctagaactttctcaaggcgttgccactaaaatggcattctgtgtgcatcttctgtacaattataaaggaaattagcactgggcgcagtggcttacacctgtaatcctagcactttgggaggccaaggcaggtggatcacctgaggtcaggagttcgagaccagcctggccaacatggcgaaaccccttctctactaaaaatacaaaaattagccatatgtggtggtgggcacctgtaatcccagctactcaggaggctgaggcaggagaattgcttgaacagggtggggcggggggcggaggttacagtgagccaagatcacgccacttcactccatcctgggcgaaaagcaaaactccgtctcataaataaataaaggaaattagctttttcactagagacagc

SEQ ID NO: 7737 - DNA, 1178 bp, Homo sapiens
gccttgagggctggtcttatgactgacaagtgaagagcagtgccaccctctactccacattctcagaagcgtctctaggttccatactttaaggcaggctagcttccaaggcatactgacagacatccctgtgcagtcctgggggcacgagggtcccattccaccctggggcttcagggtcaggtgaggaaggtagatccctgaagttgggtccagaaaaggccactgggctagcctgtctctcgttctggtcactgacctcaggatccagcaggacgctgctagcttgcttggctcagctctgcgagtgctgggagcaataagcagtgctgaaaacgcgatgcatttcaacccaaagcactctgatccctttccaggctttgggagaatgttttttccagctcggttacttgctggcatgcataggtcaatatacaaggtgttctcagagaagccggagctgaatgttgacttttgtgctccctggggtgtgttctggggaggaagtgggttttcaggttgtggtgcgtgtaggatgtggtctgggatgattagtatcacacactgtggataaagttaacacgcattgtggagcttttttcctcttttgtacttttgggcgaaggtgcctcaaaagcagctttgtttatcaaggaggtgcccttgattctgtatgcatttttaacatctgaatagaagttagacgcacacataattgctttacttgatgcagtaaatacgtttcagccagataatccataagaccctagttcagatcctgactttgatccctcttagttgtgtgagctctcaccagtttacttgacctcactctctgagcgtcagattcctgagtgtaaaataggtacaaaaactcagattgttgtaaggtttcagtgagttgttgcgtgtaaagcatttagtatacagttcttgtcacaatgtttagtaatggcagctattatcttaactattagagcggcagtttggcgtggcactaataatgatgatggtgacagtttcactgagtgcttactacctcagctattcttccaagtactttgcatcacttagctcatttaaccctcacaataaagcgataaggtaggtgctgttctaatctctgttttacagatgctaaaactcggcagccaggtgtggtggctcatgcccgtaat

SEQ ID NO: 7738 - DNA, 1541 bp, Homo sapiens
accactgcccccctcccacccaacccccccccccaccaccacagctctctgcctttccgttctgtgtggggtggctcttaagaagtggaaagtgatcatcttgttcccttagtttaggatggagggaggtggggcggggattgtgatgggactaggttaggggaagaggaggatagtgtcatcattgtgtctttaaaacacccaggcttttgtggttgtgttaccgtaatctggccagtgttgactttaacccgagttcaggggttagccgtgatgccatacaggtgagcctcattgtatgcaacagaaagcgtggctcctaacagaaagcacggctcctcaaaaagccgaacgaaaacagttgctttagagaggagttcgaggggcttgtttgaattttatgctttcgggcagccttttctaaaatgtgtcctaaagaataccagtctgtgaatatgtttggaaaatgctgggtactctgtggccgtacagaagacttagtctgtatattagcatatattagtaccttaaagacaagtaatgcagtattttccaagctaatttggctaatgtccaagaacctagtgttctgagcagggaaattctgatgtagggaaattctacactatgggcactttctctttttttttttgaaacggagtcttggtctatcgcccaggctcccagcctgaagtgcagtggtgcgatcttggctcactgcaacctctgccttctgggttcaagcgattctcctgcctcagcctcctgagtagctgggaatacaggcgcacatcaccacgcccggctaatttttgtatttttagcagagatggggtttcaccatgttggccaggctggtcttgaactccagacagacctcaggtgatccacccacctcggcctcccaaagtgctgggattacaggcatgagccaccatgcctggcccactatgggcactttctctttaaagaaaattttggaggttccctttgtaacgagaagtccttgagaatagctcagaggggtctggctctgggtccatctgccaggcttgcgttctgattctgtcaccacctctgtgaccttgggcaagtttgttctcttctgcgggcctccgattcctcgtctgtaagttgggagtaacttactcccagtactcatggggttttgttaattgttcctcacaaaaactagggaaactgagacccagagaggcagtgtgacttgcaccggttcccacggctggtggctgtgggttcttcttgtctccctgggcccaagccgtgcagtcttctctgggcaccctccctgtctctctggggtcaaggtcagctgctatttctctagacacatctttccagcttcacccctccctcatttcaggtctcagaacactgggatattcacgttttgtagttccagcgccatgtttgcctctggagcagtggtggagggtggggtgggataccgtcttggtcctcagggtactctaaagtttagaccaggtgaagggtgtagatgcgacaagatgaggcacatc

SEQ ID NO: 7739 - DNA, 1172 bp, Homo sapiens
ggcctgggagcagggcctgctgcttggctaccaatatgtgcttttgcaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtggtaagcagaaacccctatggccggataatcctggtttttgcctaagtgttaagtagatggatctcactggtgtgcagaattctacgttggttaattgcaagttgttgtagagtgtcaattagtactcttccttactagatcagcctggatcccccaatcaagcaaggccaaactcgctaccacttcctgatcctcctcttctccaaggacgaggacatttcgttgactctgaacatgaacgagtgagtgtctccctggactcgtttcctaccactgtccaggcaggagacaggtgtgccattagaaggcagtagtgttgtgacctcaccttgctttctttgtagggaagaagtggagaagcgctttgagggtcggctcaccaagaacatgtcaggatccctctatgagatggtcagccgggtcatgaaagcactggtaaaccgcaagatcacagtgccaggcaacttccaagggtgagagtgtgggcctgggatcctgccctgcctgggtatgggaaatgccgtgtctccttggtaaacccttcctgagatgggaatgcggcctcctagaggcctggatgggaccttgtgtcacaataggtgccagcgcctctgtcagaacagctcagtgaggtttacttagtcgaggacatgagcactcgtgtcgctgctgctagatacgccctttgcctctgctgaggttggcactaaccaggctccctgcaccctctgtcaggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactact

SEQ ID NO: 7740 - DNA, 1161 bp, Homo sapiens
tctctgtcatggtccccaccccgtcacctcccctctccatttctggggcaggactaggggaggccatgggatgaatggggtttctgtttgccctcggggtacatgggaggggccttgggatcacacagatgtcctggctcccctcatgactaggtcatgggcgcccactgctgagtctgtcaaatggggtcacaaaagaggacattgcccatagtcagaacttgacaacaccagctctttcgcctgcaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatgggagggaagaggggctctcatttctgctgctcattccatgagcatagctgggacccaagtgtctgggcctccgactgctccagcagacaggcagtgctccctgctgagaccccaatctcaccttcactccttgcctggccccatctgcttcctaggacccctggggcaggagcacctgagccatccccttcccaaagagtagagattataatgtaggacagatggccacaagggcctaccaagtgccaggcactttcacacacgttatctcatttaatccttagaataatcctatgaggtagatattagtttcccttgttttgaagataaaccaaggctcagagagactgagtcatttgccccaggccagatagccaggatgtgagagagctgggatttgaacgtccgtctgactaactccatcgcccacaccccatgagagaagaatgaactcccagggtccatcagccctgctgcttcagccgcctccaccctgacggtgattcggttaataaagagtaagccccatgcctttcccagcaacaaagtttgcattttagggagactggttagacagtggtgagggaccccatctctgacttgggtgcatcccaaatttagaaggaaacagaaggcatggctgtcagtgaatttttcctcatcactccccatagctctctccccaaaccagggaaggggtcattcttgttcttctctgggac

SEQ ID NO: 7741 - DNA, 1129 bp, Homo sapiens
tgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaa

SEQ ID NO: 7742 - DNA, 1135 bp, Homo sapiens
gtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggtgagagaacccggcagcctgctaggaagctgcagcgcgcagacaggaccttccttgtttccgatagtggctcagcgggagccccgtgccgcgtgcacctctggcactgctagtgcgcgcggagccagctccttggcaccggctgggaagcccagggctctatggggcctccatgaggggctcctcgcgggctggcccgagaggtctcgggtgccaccatgatgcaggacccttccctggggccactggggggcccttcacccagcgctctgtttctgtgcaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccaggtatgcctgaaaatgggctgggtgggctggggggagggatggcaaaggggcaggtggaagccagaaaaggttaggtggccaggtggacagaaagcagggtcagcagttggacagcctcacttctcgacctcttcaaacttcagggggagattgggtggcactctgcccactgtttcatttatctaatccagtggtcactgaatgccaggtgtcctgctggtcatccagaccctgggactaataggcagagtcctaagcctctgacagcctcaggtctagagctctttgaaggagacgtgctgggagaggaatttcttaatagggctatcataagacaagggagagctgcacaaagtggagtatgaatataaagggccccacatccttcccttttcaggagctgggagcccccaggttttcaaattactcatttggacaaagttacatagcctcatttactctaggagggcattgtggagagtctctggtttccacttcaatcaccttgtgt

SEQ ID NO: 7743 - DNA, 1125 bp, Homo sapiens
gtctccgtgggcattgtgatccgtcccaggcagtggtaagtgacacatgacctctgaattcaatgtggccctgatgatggcgtcgccatttcagaggtgtagcctttgggctgggtcccggtcgcctctgttcagcgtatgatcccattcccagggccctggaggttcaggttcgtgggttagagagttctcctccggtcctcgatctcctgaatagaggtgacctccaggaactggggcatcagagatccggggctcgatttccaggctcgccatagacgtcctgtgcgaccttgggctaggcctcagtttccacatccgtgaaatggggtggttaagctcactgaggttagtggcccgtggtggtctggcgccctgtgagtcctctgtatcctctagccccaggggtaggagagtgaacggcggcggtgggtgctgatggtgatgtctgctcccaggattaggaggccagaaggagatcccttccacggtgctaggctgagatggatcctctcagggcccaacagctggctgcggagctggaggtggagatgatggccgatatgtacaacaggtaaagagaactatgtgctaccctgtcttggaaaataagtcttggtcacccttatcgaaggtgaatgacttatgacaaattccttcctgaatgtaggggagcctgaggcccatgcttaccctccccacacccaccttcaaggttgatcctaatgtagatgcagtaaagggtcactagaatgagttgggcatttagatggggatggaactggcaatgcaggagccaagcaggaagagaaactccaatccaggctctggttaggttccaagaaaagctgagtatttgcctcttgacaaatagcacatagccagcccatttagtagttaacattttaaaaccctttattctgtgtcaggcacttgttaatcttcaaaataatccagtgggttaattttattagtcccgtcttaaaatgaggaaattgatgattctagaggttaagtaacttccttagggtcggcagctggtcagtaacaatgccagaactagcacctcagtctgattctgcaactagtgctcataaccatttggcaaatttgggaacaaatcct

SEQ ID NO: 7744 - DNA, 1121 bp, Homo sapiens
tgggattacaggcgtgagccaccaggcctggccaatatttgcattttttctacagacggggtttcaccatgttgcccaggctggtcttgtacttctgagctcaggggatctgcccaactcagcgccccaaagtgctgaaattacaggcctaagccactgtgcctggcccattggatgatttttttttttttttttgagatggagtcttgctctgttgcccaggctagcatgcagtggcacaatctcgggtcactgcagcctctgccacctgggttcaagcgattctcctgccttggcctcccaaagagctgggattacaggcaccctccaccatgcccggctaattttttttttgtatgtttagtagagacagggtttcaccatgttggccaggctagtcttgaactcctgacctcaagtgatccagccacctcggcttcccaaagtgctgggattacaggcgtgagccaccatgcctggccccattggatgtttttgtaacagaagactgacttataattagatctgatatttaatttgtgttctaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctct

SEQ ID NO: 7745 - DNA, 1226 bp, Homo sapiens
gctgggactacaagtgtgcaccactacgcctggttggccttggcctttgaccaacctctggaaggtctcccttgcagatttatagagcaaaataaactggatttaattttgaactaattggtgaccatgatcaaaacttagctgccatttgtttctcttcttgacagaagtaatttaatgctatggtccagggatgcctctcatctgtctctctttgtccctaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacgtatccttcaaggccttttagattgtgggattggaagggggaggaatgagggctaaagggaaaatggctgcagtaggggccggggaaagtgaggtcatgttgctctgttctccttgattgtttggcatcagaatggcagtaatgtgtgtggctggcttattcttcatccctgtagctggcctcacgggatttcacgtggttctggtggccaggggacgcacaaccaatgaacaggtatggagaaaagtgacgagagacccctgaagagcaggtcatgtctctttagccttctgattagtgtgcagtgtagtgcttccacaaagagatgcttaatgaatacttttcatgattatgtagagattaatggtagggagtgaggtagtcctagttcctcatgtaagtgtagaggccatgtaagaatagaggccatttctcacatatacaccatggaatactatgcagccataaaaaaggatgagttcttgtcctttgtagggacatggatgaatctggaaaccatcattctgcgcaaactgtcgcaaggacagaaaaccaaacaccgcatgttctcactcataggtgggaactgaacaatgagaacacttggtcacggggtggggaacataacaccctggggcctgttgtggggcagggggagcggggagggatagcattaggagatatacctaatgtaagtgacgagttaatgggtgcagcacaccaacatggcacatgtatacatatgtaacaaacctgcatgttgtgcatatgtaccctagagctgtaagtataataataataaagatactctcaaagagatactaagaca

SEQ ID NO: 7746 - DNA, 1529 bp, Homo sapiens
aaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggtgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgccccctgacttgtgttattttgtctggttgagacagggtgaacgatctctggtgggaagttatcagtgacaacctcataaacttctctggtcccagcccatctttaggcaagactataatgaaattagccacttaacaactaaaaaaataaaaaagagacccagtgcggtggcttatacctgtaatcccagcactgagggaggctgaggcaagaggatcacttgagcccaggagttccagaccaacctgggcaacatagagactccatttctaaaaacaacaggtcctgtttttatttgggtgatttaattcaaaaattcctgaaaaaaggtctcttgaaatcaccaaaactgcttgttatttgaaagcttagagaactcttaaaagttgtttctttcaagagacagggcctcattctggttgcccaggctggagggcagtggcacaatcagatcactatatcctcaaattcctgggct

SEQ ID NO: 7747 - DNA, 1215 bp, Homo sapiens
ggatggaaagaaagatagatggtaggctttaaggcattcctaggtaaagtgacctagggatataaagatttgtttcttttggagtggtatagaatttaattgttcatggctgggcgcggtgggtcacgcttgtaatcccagccctgtgggaggctgaggtgggcggatcacgaggtcaggagtttgagaccagtctgggcaacatagtgaaaccccgtctctactaaaaatacaaaaaattagccaggtgtggtggtgtgtgcctgtaataccagctactcgggaggctgaggcaggagaattgcgtgaacctgggaggcagaggttgcaggtgagccgagatcacgccattgcactccagccagggcaacagtgcaagactccatctcaaaaaaaaaaaaagaatttaattgctcacttccttaattagtttttctttttcttgtttcctacttgcaggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggtaggcaagaataggggaagagaaaagggtctttccaagaccagggacaaggggtagcttttccttcaacttctaggggctttttgggatcagagatactcgtggcctcctcccctctgcttttttttggggtgaaaagctaccctgtttttcccttttctgacttggcttagtattgacttgctatatatatataatataaatatatatataatttttt

SEQ ID NO: 7748 - DNA, 1215 bp, Homo sapiens; identical to SEQ ID NO: 7747

SEQ ID NO: 7749 - DNA, 1827 bp, Homo sapiens
gctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttt

SEQ ID NO: 7750 - DNA, 1827 bp, Homo sapiens; identical to SEQ ID NO: 7749

SEQ ID NO: 7751 - DNA, 1074 bp, Homo sapiens
taagttttgtattttttttggagagacggggtctcaccatgttgcccaggctcaggctggtcttgaactcctgggctcaagcaatcctcctgccttggcctcccaaaatgctggcatttcaagcgtgagccaccctgcctggcatagttaactttttttaataagtaggaggaatatactcaaaataataaaatatagtaaatacataaaccaataacataatcattcattattatcaagtattatgtactgtacataattgtatgtgctatacttttatatggctgacagtgccgtaggtttgtttacaccagtatcaccacaaatacatgagtaatgcattgtgttatgatactacaaccgttatgatgccactagtgatgggaaactacttcatacagatgctagggcctaaggctattcctgtctttgaggagctctgatcccagggatgaaggcagtaaattcattaatgaggtaagcattactataatgatttctttttaacatttagaagatggttgacttctgccaggaaggagggcaaggcttcactgaggtgacattttggttcgtttgaaaggataattaggattccatcagttggagaaggtgtgaagtcattcaagtcagatagaataatgtgcaaaagtacagaggtataaaaagaatgctgttcattaggtgtccacataggcaagaggaagtttctctttatagaaacatttcatctcataattgaaggtgtgattgaaatataatattatcattttgcaatccctaataaagggatcttaggcattgagcatcaacagctgctaacatcacaaaaagagatctgtatcacctatgaagtagtttaaaaaaatatcaagcctgagtctgatcaaacttgtagatccaaatactattttataggaaacacagaagatgggggcaatgtttaactataccataaggatgtaactagcaacatgggaggaattacaaatgacccaatttctttaataaattaattgcaagaagaaaaaaagtggagacagacctatagattaaaaaatatcagtctcaatg

SEQ ID NO: 7752 - DNA, 1074 bp, Homo sapiens; identical to SEQ ID NO: 7751

SEQ ID NO: 7753 - DNA, 1666 bp, Homo sapiens
ctccctcaaatgtaatgtctcactgagccctgcgcctttaaaacacacggacacatactcatgcatcaagctgctaacagctaataaaaatgaactattaacattccagactctgctaggtgcctgtaatcctaacactttgggaagctgaggtgggaggatcgcttgagcccaggagtttgagaccagcctgggcaacacagtgaggccccatctctacaaaaaacccaaaaattagccgggtgtgggatcacgtgcctgtagtcccagctactcaggaggctgagggagaaggatcatttgaacatggaaggttgaggctgcagtgagctatgatcatgccactgcactccagcctgggtgacaaagtgagaccttgtctaaaaataaaaataacatttagatcttgtctaaaaataaaaaacattccagacttggtgaaaatcatttaggtacatctttatgtgtctctatccctctggctttcagtctacaatgtcctggtgggcgggacgcatgtttcttaaccttgcctttgcccctctgacttgatgcttgagtgaagcctctttagttcttactttttgtgctcattaagatcttagccttcttgaattatggaactccttgagaatctgatgattgttacggacctgctccagagaaatgcacacacatagtattttgcctacaatttgagagtctcttgaattttaaagccgttgcaatttaaatgcatcaggaagacttgacagcagagagtttcttgataaaaatgcagtattcctttattgctgcttgtttggttggtttaaaaatatgcgatatttcttgtcctaccctagcatttctggtgccagtatcaccaatttaaacaatctccctggtaattctaaagttcactaagatttgagaagttctgccctaaagactcagcttgtcttcatagtctatctcatcttctgctcccagccacttaactcctgctacaggggttcaaactctggagtcctggttgttatctaaagggaacaactgccttcctgtagggctaaagtgaagccccttcatggagaagcactagagtctgacagtgggcccaggtcttcttcattttcaggtatagttctgaattcagaaagccaagtcatgtcccagagagctgcacttctctccttctttctgtccatctctcatcaattatttctgtactcaccttcccccacttcagactggaactttccctcttctggagttgttgctttccaccatacaagatgtcttgtgcttctgcatgttggcatccaggtgtattattattcctgtgtggtagccagcggtgcagacttagaatgccttgtaagtgcctctaagtaggatatagtaaaaaggtttgcagagttaagcttacatcccagcaggtccaggtacttctttgaggtacaaaactgatgacagggctgggcgcagtggctcacgcctacaattccagcactttgggaggccgaggtgagcagattacttgaagttaggagtttgagaccagcctggccaacatggtgaaatcccatctttactaaaaatacaaaaattagctgggtgtggtggtgcatgcttgtatttccagctacttgggaggctgaggcagaagaatggctcaggaggt

SEQ ID NO: 7754 - DNA, 1666 bp, Homo sapiens; identical to SEQ ID NO: 7753

SEQ ID NO: 7755 - DNA, 2458 bp, Homo sapiens
tcaaaagaagtatgttactgattattgtgtgtgtgtgtgtgtgtgtgtgtgtgtatgtatatatatgctctaaactctaaccctgatcctgaataagagcactctttatttctctgttggatcagccatttccttttctcctctccttagatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtt

SEQ ID NO: 7756 - DNA, 2458 bp, Homo sapiens; identical to SEQ ID NO: 7755

SEQ ID NO: 7757 - DNA, 1198 bp, Homo sapiens
tttaggctgagaactgatttatctttgtacagcctcaccagacagaaatcagactctttgggagtgctcaatggggagagggaagttagagaaattctacaatggctatattccaagttttcctagttgtggccagtgtcttttacaagtatgtttaaaaatactttaatatgattaaaatattccagttaatgagagagtttgaagtgagaaggaaaaattcttctaaatcagttttcaacctttagaactcaataaaatctgaacattcttctaagaaaaatccataggtagtcaatttcaggcagtattgggtctttctaaagtccagtcatagagcccaaattaagagttcctactgtagacatattatttactttacaacttggatccttggccagagagatgagtgagattttgtatgaaatttaggggtgatttaaggacactggggtgatgacagaagatgtggtgttttcctgtatcctcggccaggtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaatatgcgtagttccctggggcctcgctttcccatcttaaatttctaaaaacagttaagacaacaggcattttctttcttttttctctgaccacctgcagcctgttgaaggactacaggtattttcatcaagtagcgttggagacatacacaaatgggcatacaagtttagcc

SEQ ID NO: 7758 - DNA, 1198 bp, Homo sapiens; identical to SEQ ID NO: 7757

SEQ ID NO: 7759 - DNA, 1203 bp, Homo sapiens
gcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccaggctaaggtcaccagttaggaacccaggacttggaaggca

SEQ ID NO: 7760 - DNA, 1464 bp, Homo sapiens
aggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattg

SEQ ID NO: 7761 - DNA, 1100 bp, Homo sapiens
acagggtttcaccatgttagccaggccggtctggaactcctgacctcaggtgatctgcccaccttggcctcccaaagtgctgggattacgggtgcccggcctgtaaagcctatttctaaaaggaaaatggtaagagggacagcaaagcaaaaaaaaaaaaaaaaaatctgactcagaaacaacacttataggctctgaagggaaatccccactaattgtttcgtgaattttagggacccgtttgagggactagaacttgctgattcctaagactgtcatattttcagggagctcagagttatgaaaagaaatggaatgtgataaaggataaaccgtcaactttctgtttaaattgtctttgtcttgttattacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcaggtcaggaacaaagaacacctgcctggggaactttctttttgccccttttatgcacagattttgtttgtcatcattatgctgtgtcatttgattatcacctatttcctagaggtctcaagcttctcgtcttcatgcagtatttctgctggagtgatggttctcaaccagggttgattctcctccccaggggacatttggcaatgtctggagacatttttggttgtcacagctgaagggagggaggtgctatggcatctagagagtagaggcctgggatgctgctgaacctcctataatataccaaacagccgccaaaacaaagaattatctggccaaggttgaaaaattctgtcctagaggcgtaacagttgttcttttgccttttaattggctaccttaaaattttgagaaataattattttattggtgggccagtcttgggaatattattcctcagaatttggatctattcgtgctttttctcctgataccttcttacttaactctttgttagtt

SEQ ID NO: 7762 - DNA, 1162 bp, Homo sapiens
acagggccttcataaaagatgaccaaatgctaagggtagagaaataatctcgggtattttgttatgagaagtcttacaaagatgtaactgtaatatgaaagattgccttctgttttaactcatttatacaattttcctttctctcctttgtactcctaggctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaac

SEQ ID NO: 7763 - DNA, 1765 bp, Homo sapiens
tttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaacggttctggct

SEQ ID NO: 7764 - DNA, 1212 bp, Homo sapiens
tcctgttgagttaggtgtgctatgatatctgccccttcacagccatactgcacatgcaggctgtgtcacttcctaaagaggcgcccactctgcttgcttctctaccctgcagtcctcctttaaaccatctgcctaatcagctatgtatctgtactccctgtccctgtcctccgcccaattctgtatacgtttattctttgcataattcttaataagtagttgattggtgccctgtttcttaagaagtttcataatggaaagaggagaagctgatgaggagtctgcgtggagaagtgatggtaccacagaagtggaaggaggattagaaatgccagtcgatcaatctgtgagggctgtgggagataacagaaaaatggaggaaaaaaatcatagattatatagcatggtgttcgtggctgggatcaccaaatccctcttacccggggtaaaggactacatacaaggctgtgttaactttcattaaccttgaaagggaagaaatttaatttgaatttactgtgtggccggccctcttccaaaaagttcaagatgcacctaatgcaagaactaattcttgttctttttgtcacttccagataccaaggctcaaactgtttagcaggaatcactatccttcacctgtacaaagcattctgccacaccaggttataggacagattgccaccttctgtctcccccctcctcccacagactacctactaacagttcattcttcactcacttttctgtctctgaaacatccctttctttagttttctctaaccattattagcacctaatcccacccagattaaggcacctagagtgcccccaagacacaaaggtttcaagtcagtgaaagaaggtctgaccctccccacagatggctcacctttttcaggcaaatatgctcccaatggtggaagctaagatgatcgcaaggataatacagcagatcatgatcatgatcttcttctgctcatccagacaaggaaagaaagaatacatgagaaacatcatcgcaaaaagtattctgcagggagataagtgcatgtggacatggaagagggtgtgaaggaagagagcaacagaaggaaaaaggagatggatctggcttctaggacccagaatgccaacagaaatgttatttttggtgagacattcaagttagattaaaaggatgtttggtatggtcattccaccttctagata

SEQ ID NO: 7765 - DNA, 1523 bp, Homo sapiens
ttcaggctcctctaggtcacacctttgaccaccctacatctgtttcctctttcaggctccagtagtagtcttaaaagtgaagtttatctaaggataagcacatgcctatcttgctcactgctgtgtccccactttttagcacagcgcctgctgcttacaggtactcaaatatctgctgacttaattacttataattaagctcttatttcagtcatggacaaatccttgggtttgactcctaaactctttaaggtaccaatgagaacgtggtttgttactgtcagaggctgtgtaaagccgcttgggaatgggctgatctgcttatgcaaaaatgctaccaacctttcaaaccccattaccacaacatgaaaatttaaagtgctttttctatgggtggtgatggtggagttctagcaacagcctcttaatctgtggagaagatggctggctccaggactgtggttcaataacgaaatacaggcccacaaaataaaataggtttatagcatgactgaactcacacatcagtagaacactctgtgaaccataacaaagaacagataaaggtgtcaagtgagaaaggtgaaatgaggttatcactcacttcacctctcacctgatttgtgttgctagctgaaactgctggccagtaacgtatgtataagaaactgttataggccgggcacggtggctcatgcctgtaatcacagcactttgggaggccaaggcaggtggatcaccagactgaccaacatagtgaaaccccctctctacaaaaaatacaaaaattagccaggcatggtggcttgcacctgtattcccagctacttgggaggctgaggcaggagaattgcttgaatgcaagaggcggaagttgcagtgagccgagatcgcgccactgcactccagcctgggcaacaagagctaaattccatctaaaaaaaaaaaaaaaacaaaaaaaaaaaactgttcttaatacttaatactgtccccaattccattcaaggttcagttgtgttcagctttaaaaccagctatgtgaatgtgagttctagtgcagattatttagtgattatgtaactaaaattgatgaaaaaatcacactatacaactgtgaggagcacacaactgctaagtttgtacttttgaaagtaaattattctttgtttgataccttattttttaagaaagtgggattaaaaatattttggtcagtgctgttttctacccaccttcaaaagccaatggtttgatatttctattaatttgtgcttcctttagttttaataggggatagaagactgcagctggttgggtctggaaaacattaatctgggcaaacggagctggagctatgaggatctgagtcctagggggccctcattcactagcagtaagaatttaagtggtgcatggcacatagcactgtactagattctgcaggggcacaaacatagagccaaacactctccctcttggagaatttcagacccagaaaaggccacgcagttctaacttttgtc

SEQ ID NO: 7766 - DNA, 1299 bp, Homo sapiens
tttattcttcgttgtatccccagcactgagagcagcacctggtacatagtaggtgctctagagttatgaattgaatgattgaatacatcctgcaggactgtctggcacagtgcctgacacaacgagggcgatcaataaatagcagcagcagcagtgttgttattctcttttagagaggggacggcatgacagctgggatttgccagtaagttagggaaggtggggatgggaaagagctggctcccactcctgtctgtgtgcccagtggttcgcttggggtaggagctcaagagtgtctgccggcacattcgtgtttgctcggatattgtttgggtcactgatactggtctaggctctgggataggaggcagcatcccctccccaagggctgactccactgggtactccctgcaccccccacctcaccttacaatgatatttgcttctcccaggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaaggtgcagcctctcccctgccatcccccaccctgggctggttctgcattgtaatatcccatttctaacatcgtcttttctctcagctctggctaccctgaaaccacaggctggcctcattgtgccccaggctgtgccaagttcccaaccaagtgttgtggtaagtgtcccccttcccttaccagcagcccatttgtgtacagtggcccacagaactgtccttatgcaggtgtctttggtgctctgtgcctctcaccctcacctttcttctcttcagggtgcgggtgagccaatggatttgggtgagctggtgggaatgaccccagagattattcagaaggtaagtcctgctctcacctggtgggagtgctgatgggcccttacttttcaccatctgtctggagtccatcgtgactaaaatcactgtgcttttgggagttgagtggtgcagagcatggaccctgggaccagattgcctgggtttgtattttgatgccactacttgtaagctttatgaccttggcttacttagccaacccttacgtgtctcatttccctagcttctaaactgagaatatgatcatatccactgtataggcaggctgtgggaatttaaaagatttcattactgataagtgcaccttttagctcttattgttattgagattctttgcagatagtaaactacttttatatattttcttgttt

SEQ ID NO: 7767 - DNA, 1421 bp, Homo sapiens
gcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtgg

SEQ ID NO: 7768 - DNA, 1217 bp, Homo sapiens
cctcagctccccagctttccaggccagccccagccctcagtgcccctgcagcccccttatccccccgggcccgcccctccctatgggttcccaccaccgccggggcctgcctggcctgggtattagacacactcctggccctcggcccctccctagtcccacccacgctcaacctttggcccagccatcgccgagattcgagggtcaactggaagtggcgttggtgctccctgtggacttgcgtcggcacccagaggccttggagggacaaggcactgggcggtgtgactggtcatggcacttgctggccttctggccagaggtcctcctggaagcccctcctttcagtgcctggctgcagcggtgctagccaggctggagtccagcacctctcgccggtgtctgtgtgagtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttcccctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaa

SEQ ID NO: 7769 - DNA, 1586 bp, Homo sapiens
caattctggagtttgggatattgctcactggagatggtgtctcggggatagcagaagagggagaatcttgaagagggagaaatagaccaggtggtgtccttgctgacctgtgccacccagggggaggcgtgggtttctggtgagtccttcctctgccatgacaatggtggagtcttgtgcctccttcactgggggcattcccttccccacctgtgggagagcaccctcttggtcctcacagccccgcccatcttctcattgcagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaagaaaggtacatttgtttttgcttttattcaccctgcccagctatccaggactccaggttaactattcttaatttactgcgaacttaggcagtatcctcccttttatggcagttgttgcattcacttgcccttgctgttagaacagctcttttcaagtagtgaaagtgaagacatctatacctcttcttcatcacgtgattgtttgatgggatcccaaggatgatgggcttagaaattcactggtctttttggttgtccttgacaccatttgattcttacttgcctctgtcggtaacctgctgggcctgggggttgcctggactgcctttcctggttttatagccagctctgtgtgcagtgtccagtcatctagcccccaggccacctagtagctcctcatgtacctcccagctgcttgttgccacatgccctttggaccctcattttgtttcctctgatctaatcaagtgaacctttggtgcttttggtttgagaatacagcaggagtagggcacatatgggattcactcttctgtctggcaaacaaagcctgtctt

SEQ ID NO: 7770 - DNA, 1067 bp, Homo sapiens
gagcaccgtgaccactgcacgtggtcctgtctcagggcctgtggtggaaacaggaggttcagaaagtgactttcttaccgcctttcagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgataggtaaggtcacccctgtggggcacacccccacacaggcctccttcctgataccagcattctgagggactggggagagcaactgtacaagacctaggtgtttactagaggaggctgcagcacattagccctccctgagctgctcacctgggctgccctttacgtagaggatacatgctgtggggttgagctctctgcagctcactgcctccttcacttcttcagggctggtgacctcactgtcagagagctggtacaacctcctgctggacatgcagaatcgactcaataaagtcatcaaaagtgtggggaagatcgagcactccttatatccttcccagagccatccccttgctgggaagcacatcccggcatatgtggcacacggagtcacattacccggaagctactacatgtcttgattaggttcctgtacagaacaggttttttgttttgttttgtttttgactttttcatgtggaaaatttcaaacatacacaatagaacagtatattgactcccaaagtacttatcacctagcttccgctggtccatcttggaaatgtacatttatattcctgaaatgtgtccgcctctggccctctcggtgtagcaggccaaatgtgaatttagatcacaacacaggagcacatcctttcagggatttggttgagggcaacagtgtctgagactagagaaactaccagaagaaagggaaaggtgaagaagcggaaaacactgaaagaatctgccaccctgggacccccagaatccaagtgctattggaagtttgtgtagtacaggagatataa

SEQ ID NO: 7771 - DNA, 1947 bp, Homo sapiens
cctcatgagacctcctttggagaagaggtggaggtgcacaacctacttatcattgaccaacacacctttgaaggtgcacatgagctctttcgataatttttatctacgccctccctaatccaggctgttctgggctctggtacctgcaaagcctgacagatgtggcagactgtcctaggaggagcagaaaggaggggtgggaattctgtgagatggcagtgagtttggagggctgggcatcctctccttagcttaggctggtgggggatggataatctgatgagacagggacagcaggtggtacacgctttgtcactgcctaagccacaggcctcagaaatacggggttatgtgtgcgtgcagatatgggtaacctgtcatcacgtagtcatctctctactctctagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggtaagtgggcgcagtctccagtttctgagggatgtgaaatgctgagaaagtcagcaggccattgtgaggtttcagagagcctcagttaagcagtagaagaagttgggttcattgctgtaaagagctattctcttctttatttgattgaattttggagcatgtgaacagtacacagtaaaatttagcttacatttctttctttgctactctttgaaaggccaaaagaacaaaagggaggggtgggagaagtgaacgatgggtaagggaatctagtgacaacaggtataaaaattcagaatcttaggtttgttttccacttggttgctcaggcatttaggtgctctttccagcttcaactctgtgtttatattttaatatcttttctcgttacacccacccaagatggctctaaagactatcagcccggaaatctcagatcagatagctgaaatgggatctggtttccatcttgagagagagatctagagtttcagggcgagggggcagatcctagataccaactggatttctctgcacattatcttggggctcatacttcacgtggtcattaactccagtagatactgagtctgtgttgtttttttagatgagtggttttggggggcaagaatttgtaccacaggggcaaccagaggattcttttgatgaggtaaagtgtgggctcatagagactcaaacatattttttccacccccaggaaaactacagactgtggctgaaaaggaagtgaaaggggccgtgtactctatggtggaatttaacgggaagctgttagccagcatcaatagcacggtgaggcctggaccacttggtacttactttaggctgcccatcattgtctgcagaatgtgtctctcttaggttgtctggggccacgtgtgtgtcagatctgaaggagaacaaagtagcgggtgtggaggatagagctctgagttgagaatctcggaaactgaggttgaaccacgcattagactaggttacgtgaacccccatgtgtttcagatcctgagtgctgtgggacttgagaaacgagtgagacctatggtccctgcacgtaggatgttccatgccaaaagaaaatgagccaaatcagaatatcctgagtgcattcctgaaagctagtcctttgaaatattccactgcttatgccatgaccctacctcctcccttgctaaaaagtttttttccatctttattgaggtatagttgacaaaaattttgtatatcgaaaatggacaacttgatgttttggagtagggagatagcagcaaacaaaatggacaatgagctgcccttttggagtttatgagcaaataaagtacatagtacgtgaaatggtgagaagtaaaagggg

SEQ ID NO: 7772 - DNA, 1148 bp, Homo sapiens
ctacttttaagctggcctccttcaggcattcatgcaaaaatgacatctattgtaatcattagcaggactttggggaataagaaatagaagcctcatgtagcttattcgtagggctctattagggctgcatttaccacctttccactcctgtgtggaccctggcagatgcttggagacatttgttcatctgctgtttatctagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcaggtgtgtgtgtttttctgtctgctcgctttcctcctcttttctctaggacttctttgagccttggattccttcctctgccatattcttctttgttcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggaggtatgtgtcatttagggacctgggttgggacagagtcaaaatgtggaacaagaacataatgtccccctttctcacagagatcattcctcgctccatcctgatgaccacctttgagagtagccattacctcctttgtgccttgggagatggagcgcttttctactttgggctcaacattgagacaggtgagagtagtattttgagtgagggactctttcaaaaatagagtattagaattacacagaattcttagtcccagggttctgcttttgaactttcacaggccagctttttgtcctgttttctttcttcctttctcctgatgtcattctctctgtaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagt

SEQ ID NO: 7773 - DNA, 1366 bp, Homo sapiens
ctatttaactttttagagccttaaaaccaagaaggagcagagagggggttccagctcaggactccatgttccagcccttccagtggtgtcaggctgccatgtctatatatatatatatatatatatatatatatatatatatatatatatatatatctatcctttttttttttttttttttttgagacaggatcttgctgtgtcacccaggctggagtgcaatgacatgatcatagctgcagcctctttctcctaatcttaagcaatccccccacctcagcctcccatgtagctgggactatagttttgtgccaccacacctagcaagttcttttgtatttttagcagggacaaggtctctccattttgcccaggctggtctagaactcctggttccaagcagtcctcctgcctctgccttcccaagtgttgagattataggcatgagccactgcccctggcctgccctgtccgtagatatgcatgctaagtgttggtctgtcctatgcatctgaatccttggtccttgttccaggattatggccactgcggtctgaccctaatcgtgagactgatgacactttggtgctctcttttgtgggccagacaaggtaaggatgggtctagtgccagctgtaggtgctggtgagaaggttgtgaggtggggaagctggtcccaggctgacccaggccctccattctgctgcagagttctcatgttaaatggagaggaggtagaagaaaccgaactgatgggtttcgtggatgatcagcagactttcttctgtggcaacgtggctcatcagcagcttatccaggtgataactgagaaaggggcaggtgttaccatatacttgaattgacctagatgcagtacagagcaccactggattttaaaacaaccaatttttatggctccaaaaataatgtaaaaattctagggaaaaaattacagataatccactactcagagatcacaactcttaaccttagagttgctccttttagctttatttttcttctgcaaatgtctgtgtatttatttacattttcttttatagactcgggtcattatatatataaacataaaaatatagtttcggatcctattttagcactaattatatcttccgagacactcaaattttttccctttgttaaactagtgatacatccttatttataaaattagaaaatgccaaaatgcacaaaaaaagaaaaaatcatgatgctaccatccaatatgactcttggcagccctttccacatactaattataaccgaagcttaccctattctgatccttactttcaatctatctgcaatacgggggcagatagccttctggcatattgttatccacgag

SEQ ID NO: 7774 - DNA, 1132 bp, Homo sapiens
agaatctctccattttatccacatccctactatccagctttctacttggttaatttaacatcctacccctgactagctctttgcctttgtggttcattcagcaaatttgccaggcaaggtgctaggtgctgtggatacattgatgaacaagacccagctcctaccttcaaataggtcatagtttaatgtaatggacttcttctagaatatgaaaacttcggaccttctctgcagaaaaatgcatgcaaacattttacattaattttcaaacattcactacttctctgaaatccatccatggactctaggtcagcaatccttggctgattaatgggtcacctgtgggacaaccatattctttcgtcaatagtccccttctggaatcatcccttggaacatgagaatggcagatctagaaactagttattgagagtttcttttggacaataaccatctcttttgggtgggtctgttagggtgttctaggactaacataacattgttctttcttattagctcaacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggagggtgcactgaaaatacttttaagagccccctcatgaatcccagtgatataaggataactactgtttattgagtgcctatcttggtctgccaggcactttatatacattatctctaattacacaagtaccctagatagggatatttggccatctcagaagtgaggaaaattagggctgagaaagattaagtaactttttccaaagtcacctaacttaataagtggcaggtgtatctaacagatcctgtgctcattctagtaaactaggtcccagcgatctaagcaagcttgctaggagcagtggtagaagctttttgcttcctggactaggatgtcctgtctgctctgtaaatttgaaagactttggaaatcaacctctgccaagtctgcatcctcaaacctagccccacaataaag

SEQ ID NO: 7775 - DNA, 1203 bp, Homo sapiens
tggaggtagctgagtgtggatggaggtattggtagactgccaggagggcagggggtgtggacaaaacagtgttttcatataaagctctgggacttcttcatttgacttggtctgtcagataaaagttttgtgagactttagatgaagactggaagaagtgaacactttctccggcattctcaattagagcctgccactgtaactgtaatagagtaaaattggaggggcaagaggcatgagaagggattacgcagtcattgtcatttggaggacacacggctcttaggtccagtccagttttcttagtctgattagggaagtagctttgttgaatgcatgaactgagactctttgaggtgccggatttggcaagaaggggagtagctggagggagttggagaagtatgtgaagtaaatgagaattctggaggtatttagacataagtgataggattattttgaagggatgggaggcccttcccctgagttcaaaagttagagggtctgttctttcaggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaaggtaagtgttgcagttgggacaagcagtggagggggaactgttggtcgtaggttgttttatgttatttttgtttgtttatttattttctttgagacgggggtctcacagtgttgcccaggatgtcttgaactcctgagctcaagcaatccctccactttagcctctggagtagagtagctggggtattgtaggcatgccaccgtgcttgggctgtgttaggttgttttgcgaattcttgggatgggtggaatatgctttaggagaaaaactcttctcttttttctctctttggatagcaaatttcagtatgtactcttgaccaagctttctagaagtaaaaggagagattcattagggaaacatttatgaagttgacttctttagaagggagaaattaaagcagtttgtttcagaggataggctacagagtggggcagtcctggcttcatttcttgttaattctgactttaggtgccacttaaggcacctttcagatcaaatcccctgggttgttgtgacgatgaaatgattcagtaac

SEQ ID NO: 7776 - DNA, 1310 bp, Homo sapiens
aggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggattctgcattgaatagatttgttgaggtgtctggggcatgggcatgggctgatgtagacactcgaatgatggtgaaatgccaagttcttagctaggattgcatg

SEQ ID NO: 7777 - DNA, 1129 bp, Homo sapiens
gtacccactttcatgcttttcctctgcattctgtttctaaataaatttattattaaatagacaagtgaattttatgtaacacttgattttggaaatagcataagatactgaaaataagttttcattagcttatcttagatgtggtctttagaagctgaccttattgataacagcagcccatgcatctcattatgcattctttctttgcttgcttaatcacccagtgctttttgattcttgccgttggctaaagccagaaactttacagactattaacagaatcttgaggggaaaaaaatgtacataagcataattaagtgatacagtttcaaaaggaggtttttcttactttgtttcctggggtaggacaaggaagttttgtacatgttttaccaagtatttaactggattctaataaactagagtgaaatagaatgaacaaaatgaagtttgcagacctacctttgccaacccctcatctcttaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtgagtgtgggtaaccaaaaatgcttaggggtgggctggagggagagcactgggaggtgatggcattttcagaaactactgttgcactgttttgtgctctgatggggttggatttctttttcctgggatcaggttggattgatctctgaaagagaactatcctgaggacgtactggtgccgaagaaagcaatgattaagtgggtagttgctttttctgccatcttgttactgcccctgaccctggggctttatgtctagcagggtcatctgagggacgagatttcagagtgaacaccttgaactcttggtggtcattagatggtcctgtgataatggtgggtgatggggattaaagaccttgataactctagtatacttggggtaggtggtgactgttgttctgcaagttattttgtgatgttt

SEQ ID NO: 7778 - DNA, 1209 bp, Homo sapiens
ggattacaggtgtgcgccaccacgcctggccagcagtgtaatttcctcatgactaaatgtgattgaatgcattcagcacctagtaagcattgagtaaatgatagcgatgatagtcgtcattattgtaaagatgtttgtggtttgttcatttcagatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttaggtatgggactaggagtctttttttttaaatcgggcagcttcctgagccagagtaggttcagagagactcccaggagtaggagtcttggtgtcacttctcttttattagacacagccttctcaacctctttttctttttttctttcttgtttttagtctttttgctaaagaacatctgcagcacatgacagaaaagcagctgaacctctatgaccgcctgattaacgagcctagtaatgactgggatatttactactgggccacaggtactgggtatgataagcagcataatgtgaaaataggacagtttaggctgatttgagtctagaattgtatcctagataatttttttctttcttttttttttttgagactgagtttcactctcgttgcccaggctggagtgcaatggcatgatctcggctcactgcaacctctaccttccaggttcaagcgattctccagcctcagcctcctgagtacctgggattacaggcatgtgtcaccacacccgggtaattttatatttttaatagagacagggtttctctgtgttggtcaggctagtctcgaactcctgacctcaggtgatccgcccgcctcggcctcccaaaatcctgggattacaggcatgagccactgtgcctggcttataatttttttcttttattcatgaagtagacactcaacccaaacactgttcaaatttttgttaagtgtacaaaatttatcagttaaagttctttatttgcgagacagagtggaaacttgtttgtctcacttaagcaaaaaggaatttagtggaagggtatatgaagctcacagtatcaaa

SEQ ID NO: 7779 - DNA, 1160 bp, Homo sapiens
ggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacata

SEQ ID NO: 7780 - DNA, 1200 bp, Homo sapiens
ccatggccctctgggaggggcgcccgcgtgtcgctgggtggagtgggcgtttccgtgttgtagaggcagggccaggttgtcacagcaggtgtatcgtgcttctgataatcaggatgttgggccctgaaaccactccctgccctttccgtttcagtttgtctcccttcacgtgcacacgtggcatgcctgggtctccccagtgcatctcctctcgggatccctgcgtgccatcgctgtatgtgtgtcgtcactgctgctgtggttggcctgactgtggcctctgccatcctctccctgcccctctggatgtctgtggggctcatgtgcatgtgtgtgtgtacatatgcacgcacgtgcgtgtgtgcgtgcgtgtgcgtgtgtgtatgcgcatgtgtgcgtgcgtgtgtacatgtgtgtgcatgcatgtgcgtgtgtgtgtgcgcacgtgcaccctgctttgggatcctgatgtctcccctccagggcctggcatattccatgcatgtctgtctgtgcctgtcgtggtcacctgtgtgctggaggctggtctctaccagagggccatggctcatgtccaccctcagcgtgtggctcccagtttgtggctgtgtgctctcaaagctgttctattttagcctgtcctgagcctcatgctactggtcccccgtctcctcctccctacctacccctacctctcttcctcctcatgggacattccatcctggtccctgggcaggcttttagtgcccccttcctgacccccagctgaacggagcctgggctcaccacccagccattgggtcaaagaacccagcatcctgggaacggcatggagtcaggtacagacagggcttctcggtggtgcccgtctttctgtgaccctgggtgagagccttaccaaatgcacagtcttcagcaagtgggagaaggatgggaactgaggagcaagggggtgtaggctcaccctatccaatatggggccattaaactaaatgagcttacattcaacaaaattaaaatttcagctctcagccacactggccacattgcaaatgctcaagtgcacacgtgtggcatgtggctgctccactggacagcacaaatacagaacactctgtcactgtggagagttgtcctgacctcacctggtcagtctcacgtctggagggtgggaagagaactcttgatgagcccaagcaa

SEQ ID NO: 7781 - DNA, 1291 bp, Homo sapiens
cctcgcatctgggagaatgtgggctttgtgttcaccaaggaggacctcactgagatcagggacctgctgctggccaataaggtgccagctgccacccgtgctggtgccattaccccatgtgaagtcactgtgccagcccagaatactggtctggaccccgagaagacctcctttttccaggctttaggtatcatcactaaaatctccaggggcgccattgaaatcctgagtgatgcgcagctgatcaagacgggagacaaagtgggagccagtgaagccacgctgctgaccatgctcaacatctcccccttctcctctgggctggtcatccagcaggtgttcgacaacggcagcatctacaaccctgaagtgcttgacatcacagaggaaactctgtattctcgcttcctggagggtgtccgcaatgttgccggtgtctgtccgcagatccactacccaactgttgcatcagtgccccattctatcatcgacgggtacaaacgagtcctggccttgtctgtggagactgatgacaacttcctgcttgctgaaaaggtcaaggccttcttggctgatccatctgcctttgtggctgcagcccctgtggctgctgccaccacagctgctcctgctgctgctgctgcagccccagctaaggatgaagccaaggaagagtcggagggaggagtcagacgaggatatgggattgggtctctttgactaatcaccaaaaagcaaccaacttagccagctttatttgcaaaacaaggaaataaaggcttacttctttaaaaaaaaaaaaagaaaagaaaaaaagaagaaagaaagaaacaaagaaagaaagaaagagaaagaaagaaaagaaaaaaaaaataaaacaacacttgctcccacggttgtgacagtggggtttaaagaaaaccagcaggcgccgggcacggtggctcacgcctgtaatcccagcactttgggaggctgaggcgggcggaccacgaggtcaggagatcgagaccatcctggctagcactgtgaaaccccatctgtactaaaaatacaaaaaattagccgggcgtggtggcgggcatctgtagtcccagctgctcgggaggctcaggcaggagaatggcatgaacccaggaggcagagcttgtagtgagccgagatcgcgccactgcactccagcctgggtgactgagccagactccgtctcaaaaaaaaaaaaaaaaaagaaaaaagaaaaagaaaaagaaaaggagtaggcagaaagagcacacagtaggtgttcaaccag

SEQ ID NO: 7782 - DNA, 2452 bp, Homo sapiens
ggcaggggccaggtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccgtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgcccttccacccagggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctgg

SEQ ID NO: 7783 - DNA, 1298 bp, Homo sapiens
agaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaatgtcatgttctttgagaacatttgaaaatatcccaagtgaccatggctccaaatagctttccttttcactcttaacatgctgtaattgcacttgattaacaatgggtggtttgagagtggccacaagatggcaccatgctccataaaatggccatagcagctagat

SEQ ID NO: 7784 - DNA, 3183 bp, Homo sapiens
aaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaagacttcatttgtaacccatgatgttcatctgtgtgtgcacaggattcctgagtgcctctgctacgagttactgttcacctctctgtgctcttaagttcttgaatcactagactcccctttgtattgggcagaggaagaaacatcaggaccctccagaaaacaccaaggcaagggtgaagtatggcaaggaagagcaaggcaaagtccttctgatgactcccgtgttcaaatgtgagattgtcaat

SEQ ID NO: 7785 - DNA, 1167 bp, Homo sapiens
agcagcactagactggcttggcaacaggtccgtctgcactcgaggttactctcgggcgttcaactcaatggctctctctttttaaatcctgccaagaacacccttccctcatcttgcactcctaaaggttgtgggcctctctggagccattgctgcccaccttacccccaccaaatgcgtggctcagtgattaccccgcaccagctacccgcaccggggaccccagtctgaaatcctggcatttatttaaggatgcagctggtatcccatggattcgaatgggccagaaggaaaagaacagaggcaaggagggaagaaagggcggcttttggtggtggtagtgaattggatgcagagaaaaaaggtctgatgggatacagaaattggggaaagtgaataggagagaggcagaaaggagggatgaacttgacgtagatcattccacctggaggtctaggatgcccaactgttggtgggcttttgctctctaagctgtgtaggcccgacccttaacttccccacctcttgcatctcatggagacaggcctaggggaaggccagaccaggccaccataacccaagctggacaatggacaggtggtgtgggccagcagggccagggcttatctaagattgggaaggtcagcgatactgaaattccctacagctttcagtcccatcctgttttacttgcttgtggacattgcttaagcccagtgggtttgtgatgctatttagaacttaggtgggtatgtttcacataccttcagtgctatctcacctggacctttacgcggcccagtgaggaggttgggttaatgtaactcctaagtaaaggaccttctggatcctggctgggatctttccactatatgttgctggacttgggctggtctgtttctgatttcataggtaaattgtagaaggttcctgtcctgtccaggccctcaccaaaaagtttccagaaggaaaagtcaaatacgatgaatttggtctgattattccacattgttaaacatattttcttatgtgaacgcttagtctggcaattgccttgacctttctggtttaattaccatatcagattgatttatttcttccttgttctggatgttctcagtgcttacctgaccttaacactgagttccctccaaaaatcagtgctca

SEQ ID NO: 7786 - DNA, 1216 bp, Homo sapiens
gcagctggcttagggtaggcaacatctgcaccacattctgggaacacggagctggccattgttcctgggcaaggcgggcttcccggtgcccggaaggaggggctcttgaaggacaagcagggcttcacctggcaaagaagaatggaagagaggcccggtgcggtgggttatgcctgtaatcccagcactttgggaggcggaggtgggcggatcacctgggttcaggagtttgagaccagcctggccaacatggtgaaaccccatctctactgaaaatataaaaattagccgggcatggtggcgggcgcctataatctcagctactcggaaggctgaggtaggagaacctgggaggcggaggttgcagtgagctgagattgcaccactgcactccagcctgggcgacaagagcaaaactctgtctcaaaaaaaaaaaaaaaaaaaatggaagagaatcacagcagaggaagtagcatgaacaaaaaatgctttcattacatctcatcccgagtccagggagaaccgggactgcccacctcactgcctccttgttgtcagcccgtcttgctttcctccatctgtttgttcaataaacatctctgggttggtatcctccaaacatcacgcttacttgtttcatgccttgctcctcagtttctttgtgccagagatttttccatttgattcttcccaggaattttgttccttttgacaacaaacgcaaatgtgtcatttgattcctcgagcctctaagctttctttctttcttttcttttttttttttttttttgagacagactcttgctctgttgctcaggctaaagtgaagttggtatgatcttggcctcctgggttcacaggattctcctgcctcagactcctgagtagttgggattacaggtgcccgccaccacgcccagataatttttgtagttttagtagagacggggtttctccgtgttggccaggctggccttgaacgcctgacctcaagtgatccacacgcttcagcctcccaaagtgaagcctctgagctttcactctctgactttttttttttttttctctctctctctctctctcatgggttttgaggcctgccagtttccagggccctgaggttactgcaaaggccacagctgtccgttgctgttcccacccatggctattagtgtccatagactgtgtgtgccaaaagcatctcccaagtaaaatg

SEQ ID NO: 7787 - DNA, 1407 bp, Homo sapiens
ggcttttctccctgggctgcgagaagaccatccctttctgtgtggggttcctggtgggctctgagctgacagccccacaggcccagtggcagtggtaagccctggttagggccaaggggacatacatgccaccttaatgatggcctcctcagcccttgcactccctggggccactcccgtcctggtccctgaccctggtccatccccaactttgcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgaca

SEQ ID NO: 7788 - DNA, 1855 bp, Homo sapiens
gctgggattacaggctgagccaccgcacccagcaggggtttttaattttataaataaatatgtggtacagctggcagactcctgagctcagttttaaccatgctttaacatggttaatacaggagcagggaggagaaaaggactaagtgcagggtcagtactccagcgccctctcatcagacaatgaattctgacactggctgtaagttttctgtgcagtaatacagatccttaagacattgccccaggcaatgcccataatatcctaaaggttccttgaagttaagtttcaaggatcaagtttcagttttctattttagaatagaaacattactcttgggttcaatccagtagctcatctgccccccagtctccttaggcactgattccttcatgctgtgctttgagaaaggaagcctaggctgacgagaccatcttgcctccctgtagatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggtgaacaaaagatcctaggggtgtcatacttcatcatctggcagtgttcgggtatcagaaatcacttaaactagcaattgcccttataaagtgatgatacactgggcttttgccttttgtgcttttttaggcttaccatctaaactaaattaggcaaatagtaatgtcccttttgccaaaacgtggtggttagagatgatgggcttgctgacttctaggttagttggtagagatgcattaacctattctcattcagaaaccagactgtgatgactgggagagcgggctgaatgcaatggagtgtgcattacatttggaaaaaaatgtgaatcagtcactactggaactgcacaaactggccactgacaaaaatgacccccatgtgagtattggaaccccaggaaataaatggaggaaatcatttgccttagggattgggaaagctgcccactaactgtcttccccattgttttgcagttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaagtagtctgggatttttatctattaagctaaccatttgattcaggctgttgtaggacatgttcttcagtgtggacagctgtatggctgtgactggatcagtgtcctgctggtg

SEQ ID NO: 7789 - DNA, 1103 bp, Homo sapiens
gggccaggagcctcagggtgcccgttcgggaaaatgggagccgaatcaggatcaccccatgcgcccccgcacccttcccccgccggttccaacgcccgggcgcccctagaccggggggggggttctgaggtggacttcctgcgcctcctcgcagcttccctccaactccactaaacgggcacagagacgccaccgctgtcccagaggcagtcggctaccggtccccgctcccgagctccgccagagcgcgcgagggcctccagcggccgcccctcccccacagcaggggcggggtcccgcgcccaccggaaggagcgggctcggggcgggcggcgctgattggccggggcgggcctgacgccgacgcggctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatggtgagcgcgggcgggcctaagcggtggcgggggccgggcgcggttcccggggcgcgcgctggggcgggccgggggtgtggccacccgcgggctctcccgcctccctgcgcccttctggaaaatggaggctgctcgaggtttccgaggacttctctggcgcagaaagtcggggcagctggttcttctcggctgtaccctgagaatgctccctcctaggccagggccgcctctgcacacccttcttttttaaggagaccttggtgtcctgaaatcctggggttgcaagactgccagcctgtgtgatcaatcctgcggttaggaaggtggagttttgctttcccatcttttcctctgcctccggcatttggccctaaatgccagcg

SEQ ID NO: 7790 - DNA, 1212 bp, Homo sapiens
tgaggaaatccaagaggaggccgagcgcatgttcaccaggtgaagacgggcacagtgagaggctgggaacaccagggcctgtctgggctgctttggtcttggggacacaacagcccctcgtccccgcctacctggcaaaacagacagcctgtcagggctccctgctgtatactgtgtgtgcagtgtgctgggggcctgacctagtgtcatgggaagaggcagcaggagagatccagtcccttgcctattcgccatcgttgctggctgggcctctcagggtatgtggcaatggacgtgcgcctgggagcttgcttccctgccgtgtctccaggaggaagccctgagtgcccgcaggtgacttgcacatggccttggagagctcacttggtgctggacaccccagcttgacctgtcgctgccaggaaatgggcaggggccaggctgggtgggagaggggaccagtggttcccaggcagcctcgagtgacaccctccttgtgccaaacagagaattcagcaaagagccagagctgatgcccaaaacaccttctcagaagaaccgacggaagaagagacggatttcttatgttcaggatgaaaacagagatcccatcaggagaaggtaggaggggttgggggagagtgagctgagcagtgggctctgcggaggcttggtgccatctgggagtttgattctgaaggtgttgatttggaagtagcagcctgtaggaggggtggtgggtaccaccgcgggtactgcgtgggccatgctgagaggggttgggatgccacagggaactatagcttgacccaagaccctggagtccaaatctgtggctgtgtgttgggggtgggtgtgtttgatctgggccctggagaatgggaaagatttccgtaggtgggatgagaaagagaagccatccttctgttaggtgagtgtgaccaggggtgtagaccacgtgccttgtcccagccgtcatattgtcatgcttgttttagtccccctcaggaatgattggggctgcagagtgctagggaaagaggctgggtcttggggttaggcttgggtgtgaaccccagctctgccccttagcagagcagtacggctttgaattgaatttctgcctctctgagcctccgttcctcatccctaaaatggggatagtggtctctgcctctcaagggcgtgctctggattaaggcagagcgtgtg

SEQ ID NO: 7791 - DNA, 1330 bp, Homo sapiens
tgcctcccaggtggtggtcgggacaggttcaaggagtgcctggctcatgcgagctctcaaggactttgtaaggttaagctgccagaggaaggttggaaggatgtgacacaagggcgttctctgggtttgatggtggtacaggcaggggcagggctgaagagggtgacagagctctctgtagggaggttggagagggtgacagggctctgtggtgggcaagggatggggaggttcatggagagccccaaggcagtgtctggtctgtggtctcctgcaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaa

SEQ ID NO: 7792 - DNA, 1150 bp, Homo sapiens
gggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggagtcactgttgacaaagaccagaatgtacacgagctccccccttggtctcaggtgtactacagagacctcgagatgaggatggtgtggagggtgatatgtgccaccttgtggagtactcgtgagtttttcagaagaactgaactttttctgagtgggtc

SEQ ID NO: 7793 - DNA, 1136 bp, Homo sapiens
caagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgatgtcttgtgcctttgcattctgtgttgcgggggcgtgaaacctggggaagctgcacagccagctgtgagtgttcagaccggatccatctggtggcattgctagtttcatcagtgactttaagacagtgaccttcgggaggtagtgggagaaaatcttt

SEQ ID NO: 7794 - DNA, 1104 bp, Homo sapiens
ccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctca

SEQ ID NO: 7795 - DNA, 1099 bp, Homo sapiens
tcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacact

SEQ ID NO: 7796 - DNA, 1106 bp, Homo sapiens
agggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggac

SEQ ID NO: 7797 - DNA, 1311 bp, Homo sapiens
ggacggctggtccctgtggtactcagagtatcgcttccctgaagaactcactcagaccttcatgagctgcaatctcatcactggtaagagagtgggtctgagaaggaaggagaacaaggtgtagcaagtgctgtgattccaaaggctgaatgttctcccttgccgcttcaggaatgttccagcgactggacaagctgaggaagaatgccttcgccagtgtcatcctttttggaaccaacaatagcagctccatttctggagtctgggtcttccgaggccaggagcttgcctttccggtgaggaaggtggaggagaggagtctctttagggtggggcagggatataagaagcactgtgttttatttctgagttgatggatgtttaggagggttcaggaatgcttataggaaggagcagttcatgttcacaggagacctggggtctgatgacatgtgtttgagctggaagtaacacaggtgtggggtggtgtctcataacttgaccacatgctggctttttatccccagctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaccctttcctgtcctgcctcctttgtgagtggtggcgtcttcaaggggagtagatatgttgaagcagggtactttctgtgttcgcagtacctcgatatgcaggagagaagacttcagaagaacagaaatagaggcctgtgttcacttgtgattttaattaccctgcctcctacggtgatgactgtcttctagctgggaaagagcggaagcagttggggcgggtagtgacatggggctttgtgactacctaattcttagggatcagattccaggcctttcccagtgaagggagagaatagctgctaataacaagagctaacgtgtataattcacagagcgcaaaggaactttacattatttcctgtaactgtcctgtgaggtaggtagctgacaatatgcaagggttgtagtttctttttctttttttttctttttttttttcagacaaggtctggctctgttgcccaggctggagtgtagtggtgcagtctcagctcaacctctgtctcccaggctcaagccatcctcccaccttagcctcctgagta

SEQ ID NO: 7798 - DNA, 1311 bp, Homo sapiens; identical to SEQ ID NO: 7797

SEQ ID NO: 7799 - DNA, 1205 bp, Homo sapiens
caggttctagagccttctttccgccaggcctttcccaataccaaccgctggttcctcacctgcattaaccagccccagttccgggctgtcttgggcgaagtgaaactgtgtgagaagatggcccagtttgatggtgagtctgaggagactgggaggcatatggccaggatcagggtctggtttgctctgcatcaaccccttgatttcctgtcttgcttttgggttatggggacctgcagaatgtagggtgtcaatgtggtagctaatattatgtgcagtttcgtgtacactcataccctgactaatttgtattactatatagatttgcgatataaagtatttgttgctgagtgtgttgttgctggaggacacacagtgaactgatgagcagtctggggcctaagttccttacttgtcccattcgtcagtttcctctgttaccttgcttgctctgtgtggttttggaggggtgtggaaagaggcagaacattcgttcactttcctgccttcctctgcaccagctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagaggtaaggatattggagggtggagggtgtgggaccaaagaaggcctgttctcacctctgtatgtcccccctcacacacagctagagccagaattttaggttgtccatataaagttaaaggtatattttagttgcaaataaagcagctttctggctgataatcaggaattgggcaaattttgattgtggagagcaagtttcaagtacagccagtactggggaagattgaactcctattccaacaaagacaggaacagattttgatatagtggtaagttggttttgagcaagctcatttgaccatttgagagctctgagaacaaatacagggagaggcgtggggaggaagaaagtgcagagagccttgcggtgcgccacgcgcccggctgtgcggagatagtggatgccagagcagggtcctttgaattgttttgttttctgttttgctgaatcagactgtacaaaaattgctcactaagaaa

SEQ ID NO: 7800 - DNA, 1220 bp, Homo sapiens
acattcctttacccctcaatacttcaatgtgtgttatgcaagaacaaaggtattctagtgtaaaggtattctagtgtataaccacagtaccattatcaagttgaggaaatgttacattgacacagatgtaaacctttacagactttacagtccatactctaatttggtcagctgtcctgtcaatggactgttacagtttctctttcgtctgtaatagttcctctgtttttgtctttcacgacaatgacattttttgcagaggtagaccttttattttatagaattaaaaggttatctttaaaaaaaaaaagggttcctgtgaagattaaatgagttaatatgtataaagaccttagaatagagctgaataagctggaagtaatattatcttgagagatccctgcttagggaacagcagaaacatttcactcagttcatttctgtccacagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggtacctttcttttttttgagacgacatttcactcgttgcccaggctggagtacagtggtgccatcttggctctctgcaacctctgcctcccaggttgaagtgattctcctgcctcagcctcccaagtagctgggattacaggcatgcgccaccacgcctggctaattttgtatttttagtagagacggggtttctccatgttggtcaggctggtcttgaactcccgacctcaggtgatcacctgcctcggcctcccaaagtgcggggactacaggcgtgaggcaccatacctttctttgg

SEQ ID NO: 7801 - DNA, 1198 bp, Homo sapiens
cttcatcactcatcttgactggtccaaggatgggaatttcatcatgtccaattctggggactatgagattctttactgtgagtggcagtggagcaggacatggggagagggtaattggagtgggttttgtgtagggggggctgttagaggtgttgttagataaggaagtggagatggggttaaagtggagttggaattatatgtaggagaaatttcgtgatttggaaacaactagtttcacaccatgtcttgttgacttgagggagttcaaaaatgcgctaagaaaagattgtttgggaaaagtttctcagggcaagtgtggagcacttgacttatctagggaggaggaactcgtggaagctgttagaacttcagccagagctcaggacaggacgcacacagggtgggtttcacagggggaggaggtgatgctactacggtgaccagatcacatgccatcgccgggtttcatgccagtctttccagtctggctttccctggcatcttccctactgagggcagggtgagagctgagctgggcgggctccctctccccaggggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgttgggtgagagtccagaaacctgaagatccagcccaggaggcccctcgggaccgggaaggcttgcctggaacgcggcagtgggtggccgcggctgccggagcgcctgaaatggtgtagctctgggccgtgggtggcggtgggtaggaggtcgggctgaggccggccgctgtgctaggcgtctggccggacggctccgatgggaccgacatcaactccctgtgccgctcccacaacgagcgcgtggtggcggtggccgacgacttctgcaaagtgcatctcttccagtacccgtgcgctcgtgccaaggtgaggccgcggggatcgccggggtgggaccggtgggcccgagggctcagccgccaccgcaactcttccctccggcccaggcgccgagccgcatgtacgggggccacggcagccacgtgaccagcgtccgattcacgcacgacgactcgca

SEQ ID NO: 7802 - DNA, 1221 bp, Homo sapiens
ccaggatggtctcaatctcctgacctcgtgatccgccttcctcggcctcccaaagtgctggggttacaggcgtgagccacgcgcccggccaaggcccggttttagaggcactaagtcttcctccaccctgccctttacactttgaagcctatactgtatatgtcgatagggttagagaatccattccaggctcggggacccagaggcctggctgcagctgggcctggctctcactgcatccctcctggcacaggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctggaggggcctcttgttttcctttgcttcttacattgggttcttgctttctgatccttacagatgtgggctcctgttgctgcacaggtcgagccagggtccaaactttggagtcctagctgctccatcagacagaaatcagttctcccaggcccccatccccttgacaagaaaaagcaattgcttccatccaaaaactttattgagtctatatcagaatcagcctccaggccttctcatgtcactttcccatcactctgttctttgctgttccctggtggttctgactacaagggctaggccctaggacatctggttttctttcttaccccagtccagctcgctgactatccttagcccctctaatcctacgatccccccaacctggagccttggtaaggagttgtgaggttttcagacttgtccatccctccctcttcctcaccccaagctccaggcctctaggcct

SEQ ID NO: 7803 - DNA, 1522 bp, Homo sapiens
agcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaataactggtggtagtctggattctagttctagcctgagccacagaccctagaagcctagagaccttacatttgctttcctttttttttcttttttgagactgagtctcactctgttgcccaggctggaatgcaatggcatgatctgggctcattgcaacctctgcctcccaggttcaagcagttctcgtgcctcaacctcccgagtcgctgggactacaggcatgcgccaccatgcccagctaatttttgtatttttattagagatggggtttcaccatgttggccaggctggtctggaactcctgacctcaggtgatccgcctgcctcggcctcccaaagtgctggaattaaaggagtgagccactgcgccctgggtctttttttttttttttttttttttgagacagagtgtcgccaggctggagtacagtgtgtgatcctggctcgttgcaacctctgcctcctgggttcaggcagttctcccacct

SEQ ID NO: 7804 - DNA, 1369 bp, Homo sapiens
aggagagttggtggaaagagggaaaacagcccagagactgagggcctagggaacttgcaccagatgacagctggcttttgctcctcactacccgtctcttctctcctcacccagcacatggcgactgctgatgggctgagacagcgctctgggggcatggaacgcccctttgtcctggccagggccttcttcgctggctcccagcgctttggtaaggtttagagaatggagctgtggcagaagggtgtgaaggccagatctcaggagccatggacctggacctgcctctctgaggaatgggagccacacactgcatctgtttcctctcagctatgcgctttgaaggaagtcagggtgtgggaggtccactccttgttcaaatgttcttgtgaactgcatcttcagcagggttctggggacccagagcggatgtgggaggtcagccatgtaaaaagctgaactcctttaccatgtgcaagctccccacttcttgtcttcctcaggagccgtgtggacaggggacaacactgccgagtgggaccatttgaagatctctattcctatgtgtctcagcttggggctggtgggactttccttctgtgggggtaagacagggaggaatttggggtcttggtttggtgggaaaggggcaaagtagagggcacaggaccaaggtgttgtaagcaaagagagttgagagtccaagttagggccttgggaagtttctcaagcagtatctctccttcaccctcttttccaacctgcttcctctctctcctctaccagcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggtgaggcattcacttgggctgtgaagagtgggctgaggtggctgggggtattagggactgggcttcatctctgggtctctttcttcactcactacagccttgtaaaggatggaaaatcattaaggtcaagagtgaaggggagcttaatggagatgaataatagtaaacatttaaagaaaattgacagcagtcataagctctttcagaaaaataaaacagggtaatgggattaggtggtcataaaatccctttttgaggccgggcacagtggctcacacctgtaatcccagcactttgggaggccgaggtgggcagatcacctgaggtcaggagtttgag

SEQ ID NO: 7805 - DNA, 1099 bp, Homo sapiens
ggggttggaaaatgggagggcaggaggtgtctgacccctttgtggtcacctatacagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggtacatggttttccctgcctcattcttctgctcttttcttgtcgggtgattctatgtgttttcagagatcctgtgccccagcttgttttctaggtttatacccctcagcctgcctctagttcacaagcctccctcagtttctgggtgttgggcctgatcctcgttgtgacccccatccctcatgaacctgcaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaaggtaaggggttgcagtcacgcttggtcttctcagggtagggctgaagcatagtttagccttaaagagacctgaacacccctgttccttgcccccagctggtggccatcgtagacccccacatcaaggtggactccggctaccgagttcacgaggagctgcggaacctggggctgtatgttaaaacccgggatggctctgactatgagggctggtgctggccaggtaagcagacccagaattgagggagagttgattggccagcggggtagaatggtggctcttttgccccttaggggattgagagccacccttaacttctcccaggctcagctggttaccctgacttcactaatcccacgatgagggcctggtgggctaacatgttcagctatgacaattatgaggtagggaaggcctctccccatgacctgcgtctgtctgttccacctgcctccctga

SEQ ID NO: 7806 - DNA, 1174 bp, Homo sapiens
tgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcat

SEQ ID NO: 7807 - DNA, 1114 bp, Homo sapiens
gaagacgaccccgatgtggacgagcctttagagactccccttggacatatcctgggacgggagcccacttcctcagagcaaggcggccttgaaggtcctgactgagggtccacggtgtgattattcaggagggtccgaggagaatctgaagggataataataccgattgtttgtttgtaggatctggttctgctgccggagaaggcaaacccgctttgagtgaagaggaaagacaggaacaaactaagaggtacagtaacaacaatctcacgtgtctgagggtcgtcttccatctctccccagtacacgtctggtcaaagaaccttgacctttccacatttcctctttcttggcattttcttttcctttaatctactttgggatatatgtcgcctaattttgtttattgtaaactttacaccttcccactctgtccatttctcttgaactgttttccctcggcaacacaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccaggtctgggcaggggaaatgatggatagcagatgagaaagaaatcaagatttgctttgttgatgtctgacctaatttcttcttgtctacatttcagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtactgattctaattcttatcttcctcttgggacccctttgtt

SEQ ID NO: 7808 - DNA, 2966 bp, Homo sapiens
agcagaaggatgagtgttatgcctcttcatcctcagccagctctggctccaagtgatggggtttccctctcttctagtggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcaccctatctcctgtggctgcactgactggggcggagggtgtcactgggttatttattcattttttaatgcctctttctcaggtcgcatgggctccaaccaaggaggactctcctcttgcatggtggctgccgttccctcc

SEQ ID NO: 7809 - DNA, 1496 bp, Homo sapiens
actaaaaatacaaaaaaaaaaaattagctgggcttggtagcgtgtgcctgtagtcccagctactcgggaggctgaggcaggagaatggcgtgaactcaggaggtggagcttgcagtgagccgagatcacgccactgcactccagcctgggtgacagagagagactccatctcaaaaaaaagaaaagattatcacatcttctaaaaacatacatactagccgggtacggtggctcatgcctgtaatcccaacacattgggagtctgaggcgggtggatcacttgaggtccggagttcaagaccagcctggccaacatggcgaaaccccatctctactaaactgctggggaggctgaggcgggaggatcacttgaacctagaagccggaggttgcggtgatctgagattgcgccactgcactccagcctgcggcagtgagactgtctcaaaaaaaaaaaaaagaaacatacataatagagcagaataaaaacaaacctgtcctttacctgtcatctcatattttgcaagggctgaggtcctcacagagaagagaaataggctgggcgctgtggctcatgcttgtaatcccagcactttgggaggctggatcacctgaggtcaggagtttgagaccagcctggtcaacatggtgaaaccccatctctactaaaaatagaaaaaaataaccaggtgtggtggtgtgcactctgtaaccccagctactcaggaggctgagacaggagaatcgcttgaaacgcaggaggcggaggttgcagtaagcagagattgcatgccactgcactccagcctgggcaacaagagtgaaactccatctcaaaaaacaaaacaaaaaaaaaatgaggaagggcatttcttgcttagtgccttttaaacacctgatagaactctctggaagctgtgttggacatgggtgcaagttgcagtatggtgcagtcctggctcagtaggaggttccatcaaccaggagcccctttgttattctgtttctgttttttcatggtggataatgtctatgatgttgtgggtactacataggtgagactatatagcacagcctctacctttataagtggtggcaataagcatgtgattaactgtcatacaaccacagagcaaacagatttcagggaaaaaaaaacacactttagtcctttatcaataacgccccctttctcaatgggctagactcctctttgttcttccctatacctttaaagaatacaactatcagcttacaagaaaaacttttcctaagtccaaggacaggagaggcgcagtggctcacccctgcaattccagcaatttgggaggccaaggtgggtggatcacctgaggtcaggagttcgagaccagcctgactgacataatgaaaccccatcgctactaaaaaaaatacaaaattagccaggtgtagtggcacgtgcctgtaatcccagctactcaggaggctgaggcaggagaattgtttgagcccag

SEQ ID NO: 7810 - DNA, 1218 bp, Homo sapiens
gcctgtagtcccagctactcgggaggctgaggcaggagaatggtgtaaaacctgggaggtggagcttgcagtgagccaagatcgtgccactgggcgacagagcgagactcggtctcaaaaaaaaaaaaaaaagttggacattcaggttgtattcagggccatatgcaggtatatgtgaatgagtttctgtaggttacatttatagaaatagaattgctagatcaaagaatatgaacattaaaattgtaaaacatgaataaggtgatacactgtcttccagaagaataccgcattcatgttttacaattttctggtggatccaatgcagtctgggcccttccttttaggttgcactccaggacttgcagacgaactccaagattggggcactcctgccttactttgtttatgtggtcagtggggtaagtgaccaggctgggacagggagaatgttttataaggaagagatgacccagcaggtgtagggctcatggcaagtgctgtcagaatggtgggctcctgcctgtcccctcatgtccctgtaagctaccctcttctcccaacaggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcc

SEQ ID NO: 7811 - DNA, 1140 bp, Homo sapiens
tgagttatgattgtgccgttgcattctagcctgagcaacctgtctcaaaaaaatttttttaatttaaaaaataaattagtcgagcatgatgtcacatgcctgtagtcctagctacccaggagtctgaggtgggaggatctcttgagtccaggagtttgaggctgcagtgaactatgatcatgccacggcactgaacttgggtgacagagtgagaccctgtcccaaaaaaaaaaaaaaaagaaaaaattttaaaagattagaaaagatctcagagctaagcgtagggactgggggtatggggagccagctggctgtcttcaccagggtctcctccctttgttccttccaccctttgcagttgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcag

SEQ ID NO: 7812 - DNA, 1152 bp, Homo sapiens
agttaaaggacatttctggccatggaaacgaagagctcctcacaaaacttcaaagtggcagtttgagaacaaggagaatttttagaggatccttaaactggtcatatttgtaactggcgtctgcactgtatagacaaagtactgagtggcagatttcaggtggctttcagaggtctgatttgtgttcagttacacttttgggtctcacatttctacatcctgcttctctctaattccagtttctacttcatttttcaaaagccctacacagttttccagtaacttttccctgatgctgccctcccacagagagggttctttcctgtggatagggagcggagtttgcatggagatggcctctgtcgttagtatgtatctcttccaatagttcagagtactagaagctatgattgccacaccaaaccggaccagttacttacttctaatttgtgttcctgtttctaactctagaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatagtgagtgaccagttggtctggtttgaatttagtggctcatgagattatatggcccttttactgtccatgtcatttcctttcccacctgttagagtgagaaatgccaggactagcttagtgattaaacagtcttagttgtagtcccactaacagtgcaggaaggcctttgagaagactttcctagcatttgtggtcattttattctctgcttacccacagcaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacagtgagtactttgagaaagtagatggtacagtagagataggaggccacgctgagagtggagatgtttaattttattccacaaaaattattattattattttttttaaatggagtcttgctct

SEQ ID NO: 7813 - DNA, 1739 bp, Homo sapiens
gccagcgttacagtaatgttccaggtaggtgtacatggtttatgctcttacagaggagaccttgtagataaccactccatgatgaacacaaaatgacaagcatatggctgaactttcaagtgatgtcatcttactactgagaagtgagagagaggtcttaaggggtctttgaatgactatttttaggtacataaaatgctttcctctgttgtctacagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagtaagttgtttttcgaattctatgggcctattatctaatagataacttagccattttgatatttgttaccaaagcctgcttaacccataaagttttctggttcctcttgttctctgtagtgatgtttctagatagatgcccactgatatatgccccttttttctcagatagatgcccactgatctgcccagggtcagacgaatgcttgtcagttgtagctttccaggattctgctccaatgaggaggaaacatcctgccttacccctgttttagcctgggaaccagtaattgtgaactcaccagggttaacatgaagagggcatgagagcttattccataaggaattgtctgagacatttggttaccttttcttagtttgtccattagcaaccgtaactaaaatagttttggctgtttgggataattagctaattgaatgattttttgattcaggagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctg

SEQ ID NO: 7814 - DNA, 1739 bp, Homo sapiens; identical to SEQ ID NO: 7813

SEQ ID NO: 7815 - DNA, 1739 bp, Homo sapiens; identical to SEQ ID NO: 7813

SEQ ID NO: 7816 - DNA, 1739 bp, Homo sapiens; identical to SEQ ID NO: 7813

SEQ ID NO: 7817 - DNA, 1739 bp, Homo sapiens; identical to SEQ ID NO: 7813

SEQ ID NO: 7818 - DNA, 2080 bp, Homo sapiens
gagtgcaagtagccatgcaaagttgggaaaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgat

SEQ ID NO: 7819 - DNA, 1150 bp, Homo sapiens
tatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctcc

SEQ ID NO: 7820 - DNA, 1527 bp, Homo sapiens
cccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaatttctctccttcctcccctcccatgcgtctcctccaactccttcattatttatgtagggtcccagggccagaggagagggggcctcccaaagtcaacagcatggaggtgtcagggctgggaaagcacccatgcctcacccatgctgggccacggggctctctggacatcttgggtcttgccgactcttaacttcatccccttcagcaaagggctctagccaaacatagttagttttcctgtttttgcagacttggcctttcacggagagtaggggtgggatggtctggtttttaaaaggtatttctaaaggatactagaggtcatgcattcaagaatttgttgaacactcagcacataccagaaactgtccctgttctggggtcacagcagggaacacagtacaaaaattcctgcctccttggggctcat

SEQ ID NO: 7821 - DNA, 1127 bp, Homo sapiens
gaagcacatcagaactgatgagaaaaatatggccatggcttccctaaagatcaacacaaatctgttttccctgaagaccaacacaaatcttccctgaagatcaggagaaagctttgcaaataatgccataataaccttataaagtaggtactcgtgttatttctttttatagacaaagaatctgatctcacagggtaagtggcttgcccaagcatggcttggttcatttcaagacagagactgaaactcagatctgagatctgcaactgttatgggttgacttgtgtccctccaaaaaatacattgaagttttaactcttcgtggatcagaatacgacctcatttggaaatagagttgttgtagatgtaattagctaagttataatatgaggagattatactgaggtagagtgggttcttaattcactatgactcgtgttcttataagaagacaagagagagacacatggggatgttatgatccacagaggcagagattggactgatgcgtctacaagctggggaatgccaagggtttccggcaaccaccagaagctggcagaggcaaggaaggattcttccctagagcctttggagaggacacaccaacaccttgagtttggatttctagactccagatctgtgagacaataaaatctgttgttctgagccacccaatttgttgtgctttgttatggtagccctaggaaactaatatacggcacgattcctgaatatttgaaggaactgctggctttataaggggtgattggaagaggattgggactagacaagcatggcaatgagggaaccagatgtggagcaaatgggagagatttttaaaggcatcctggaatttctgggagagaggaaggtatttagagagaattttggcatgctttctgtgcaaagaccctaagaaggcccttttaagaaaacttaggctagatgtcttgattattactcagggtgtcaagagtgtgacttgtgtttcccttgactgtgtctccatggtagtctgagccatgcaagtccttggattccatcaggttacactacagaagctccatgctattgcatttctctttgctttggtgctggttatgatccccttattctagtagtgt

SEQ ID NO: 7822 - DNA, 1425 bp, Homo sapiens
gctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttt

SEQ ID NO: 7823 - DNA, 1191 bp, Homo sapiens
ttttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggcca

SEQ ID NO: 7824 - DNA, 1069 bp, Homo sapiens
ccataatggaagcccaaagacatttctaccgttaaaatacataatctgccgaccctaaaacattcacataaagaggcaggagggaatactatcccgcagctccacgattagccgcagtcgtgggcggggattggggcttggatacgccttttgcgtctggtccccaagggacgctccccaaccctcggcgcgcgaggcgccgcgtgaggccggctttgcccctccttccctgcaagagcgcagaggagcggttcttgcgcctgcgccctgcgccgctgcgcgctttggcacccgcttggggccctttgtgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcgggtaaggcgcgcggggagcccccgccctgggaaagagggcgagcgggagcctgggggctggggggattaggaggcgaggcgggaggaggacgaattaccctcgactactgacggcttcagccccccggggacgagcgtttggaaaatgggcaaaggggaaggggaacgtaaggttgtgcaggcggtgaggaaatagcggggtgtgaggaaaacaggttgggggcggggagatagtccagtgggcgttaacgccaagactgggcaggtggggaaaaataccagctcgtgggataaaatggagagttgctcgatgcatatggtgaacctgggtgatttagtgaggattagagagattgaaaggatacgggcaggtgggtggtgggagaaacaatttgttactatttttgaggggatggtggtgaaagggttg

SEQ ID NO: 7825 - DNA, 1836 bp, Homo sapiens
ctttttcccctccttttctcaataggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaatgactgtggcatcattctgctaactttattctttatacacagtttgggtaaagtaagaaccaaacactgcttcca

SEQ ID NO: 7826 - DNA, 1517 bp, Homo sapiens
ggtgatgtaggtgttgacactcaggagataaagagcctggtggaagttcgccaggggtcttttctgtcccccacgtagtccctcatgagctccttggtgggcacagctatgccttagactgcttctgggtgttcccaccccatcacctctgccccactcaggcagaacccgttaggctaggatgcccagtaagtttgagataaaatggagttggctgcaggtaggagttacaggaagaggcacgagcaccaggcgtccctgtgccaaaatacacacaggaggaaggctgcctggcttcagctggcttgtccctagggaggctgtgcgcctcattttctagctggcagcagtcctcgatcacccaggagtggagctccctgccatccttgggcttcccctcatgccaggcactgggctgtggacataatgaaagccctggaaatgtgggtacagtttgcggagcttccagggggcatcctcgtggtggggtgtctggggggctctgactgctctctgctctcatccctgcccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaagagttccgtctgggccatcattgggggagagggtttgctagcaggatacctggccacctagagcaaccctgaggggcaggagggttggaagatggtcctggggggagccagggagccacctctcctgaaggtgggacagcaccagggcaggcctctgtggagcccaggaacgagggctgacttgtgctatcagtc

SEQ ID NO: 7827 - DNA, 1199 bp, Homo sapiens
gtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcaggtaaggagccccgagggctccccgaattctctggctgggccctttgcaccttgcggagcctcctccctcttctgctctcctcgtgcccctgctgccatcctgcaagcctcggctgccctgtcatccggctcctggctccggctccgcacatcccgcttccgagtcctgacctgggacccacctcgtcctgactccaagctgcacacttgtctttctgccaacccccgtctcccctcaccgccctcctgcgctcttccgtgtcacctccccagcttccctttctcttccctttttctctcaggggcctttctggtcttcctccacccacgcttaaagcagccaccctcccgctcctcgaatagcagcaccccgcgatttgccacagatcgttgtccacctctcccttcgtctctcctgcctcgcttcccctccgcccgcaccggttctgccagtctctgggttatcaccctcagggtccttgccctggactgcgctctcgatccctggccccttgcagttcccccagctttttctaccctgcttcttcgttttccaaattgtgctctccctcttgcttgcaacccaccagctccaccctcatcacctttccaaatccttcgcctactctttgctcatcactttcccttctttgctccaggagctccctggatcctggcgctggcatttgtcgcttccgtgtttccccacagctgtcatgcgcatagttttcccacaggttgcgtttggggttccaatcatcactcccttcagagtctttggatccctcttgttctcttc

SEQ ID NO: 7828 - DNA, 1357 bp, Homo sapiens
gggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttattttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgt

SEQ ID NO: 7829 - DNA, 2232 bp, Homo sapiens
agggtcctgtgaggggcatagtggcctgcctgagatgggagtctgatattcctccacttcctggccttcccaggtacagagcatgaagcagacgaacagcagcctgcgccaagccctggagggcggtattgatccactacgccccccggaggtatggctgctctttaagttagggtgcaaaggggggtttctctctggaggcagagcagaaagagtactgcttggggagcagggcttccatttgcatggttttgagtctaaaggatatgttgttccttgctttccaggccaacaccaagttcaactcccgctggaccacagatgagcagcttttggctgttcaaggtgggttaaactgtggtgagaagagaggaccccaggaatctatctccccaccctccaaggagtgggggggcagaggggaagggtcagggaagtaactagttcgaaggggtattgacgctgctgcccttttgacccttgcagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtgagaagggggtgagagaaacccctcagagaggagaggcgaggcgaggtgaggcgccgccttggtccttagactgggctgagggcgggaagagcctggcttctcactctttcctctcccctcaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaagcttactgagttttctttcccttttggtgcaagggccctgggctttgcttcctgtctgtgccctgtgggtaagtggggagctgggcccacccagcactggccccagacaggaatcaagtctctcctgcaaggcaggtgggctaggccacatcttgcccacaggagactgggtccctgcctggctgggagaagaaacaggaggaggcagctcagattccaaacattctctttattacgtgtttgatccagaggagaaactaagtgcagggttggggaggagggggctagacggggaggggccaccttgcctgggtgccccgggcccctaccccctttgggagccaagccatgccctcccagccccctcagagcacccgggctgttccatagggcaggaggggggaagggagggagggggagcccttggtctgagccgcagta

SEQ ID NO: 7830 - DNA, 2633 bp, Homo sapiens
agaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatacgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaatcagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatatttttttttttctttagcagcttgttatcactggaatcaaagggaaaaagtgatctcttcttgcattggttgtatttgtatgtcacaaataaaagacactttggtcagctgctgagatggcttcctgatgctggggcaccatgggcagcgtggatctgggaagctctggaccctgagcctgtcccaacattgggcccgaacatcaggaggtgcatagctatgatagccccatgctggagaaaaaactcaggctgtccggggcaagcagccagagctgggaacagagaccaaatgtatgtgtttgtgccacttcccaggagttctgagtagaggc

SEQ ID NO: 7831 - DNA, 1310 bp, Homo sapiens
aagccaagccattctcctgcctcagtctcccgagtagctgggatcacaggcgcccgccaccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtaggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacttcagaaattcattgtgccttccctcctgcctgggctcatgcctccactggcactgggtggaggtgtggagaagagcgcccggctggctgccctgtggtaggttttgtgtgcctcagctggactcctcgtgtgcttctgtacctttaaatggtgcctggcttcctgggaagacaaagcctgttgtcattgtgcagcttttctggctcatcccctccagctcccttgtttgtgcaaagcccaatgggcgtgtatgtgtctgtgtgtgtgtgtgtgtgtgtgtgtgtgtgtgtgtgtgtgtgtcccactggggctggatcttcagctagaagcctttcctctaaggggccagccttctctggtcttcctttttggtggacttcatttcttaggtgctggtgcccttcctaattgggggtagggactttgcagaatcttggct

SEQ ID NO: 7832 - DNA, 1102 bp, Homo sapiens
ccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtgg

SEQ ID NO: 7833 - DNA, 1152 bp, Homo sapiens
cctcttcagggaggggaaagagtgaggggggcgggcagggggacacctggcaactgccctctccaaggatccccagggccctgctgagtggcaagagagatgcccacagcctggctggagaccccttcaaccccacagcttttcaggatggaggagggtggggggttgggagctctccccgccccctttccctcacagccctctcctagctcccactgcacccttcccctccacatccctgcagctggacccaagcccaggcagcgacagcccctcccatatggcagcaggaacaaagagaactgttccccacaacaaaatccagaagctccggcgggcggccagatctcaagctcccagcccagtgtgacccacggcgttctccatgggccactgacgcccgcggggccagcactgctcctggcttcaaaaatataaatttaaaaatccccaccccaagataattgctctctcctctggcttattgtggtggctccgtggtaggcactgagaagcaattattcacggctaatgattataatcaagtcaaatagaatttaatggacacgtattctcttcctgcttgaaactttacatatgaattaagcacatatgggtttcacgaggcacagacgcagatttatgcagccccgaaaagccctgccgttgccaacgacttttattccactaataaacaggctgatatatgggctcctgggaactgcaatctctgctgccccctggtgggcacaggggctggggtgggagccaaggccacccaggaccctggaggcctgaccagtgccaaagccactttgaacgctggggttccacaaagccctggacggctgaaaggagactcgggctctgtgtgggaagcccgtgttcagaccctgcctccgtcattccctgggattccaggcgggtaccgggtcctcctggctgtgagagtctagaacaaaaagatcccaggagaacacaccaagaggtgtatgggtaaactgaggcaagcagggggaggtgaaagctgatcatttgcaggaggtaccatgtccctcggcaccgctgggacaggggtgatgcccagaacggcgctgatgacaccagtttcagcaccagtgcgaggtgctgagccccgattcccgccaggtg

SEQ ID NO: 7834 - DNA, 1269 bp, Homo sapiens
tctgctatttggatggatccttacagtagcagccttggcctcgtagcctactcctctcctttttttctctttggccttcatgtgaatactcatttttcccccataaaagtagaattgttcttttttgagttcgtcttctagatttacctctgggtgttctctattttgtgtctgtctttggtggtttaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcaggtaggtaccacgcacagttttctttcttattattaatgtgattaattttgagtcttcacccctgagaaatgtcagtctggtagggtatgggacacagtaattctagtgaactcatttcatagtgatgtgctttcctttatttggacagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgtaagtggacgccgctcactgaggttctggaaatcggggaatgttatgctttcttcctgtaacctcacagcagagggttccctggtctaaactgcagagtttttgcctttgcttattctctgcagagcagtaggtggtggtcgtttatttgtaattatagaaagggtcaggggagcatatttcacagtaatctagaatgttctttgtcatctgtatacacctctctcctgctcttctagaactctgatctagcgtcaaccccatcctttccatctacttaggccctactttctctgttggtatatcagagtggaaacagggttgaagttcatgtgtaaagatgtgtctaaatcttgtactggtattcatctctatcaatcctctggctcctgagatcagctacggaagtatacctaaaacaactcattcctctgtgtatctgctaaccttgaggaataaacttgacctctgtgacttcattttattttattttattttattttattttttcaagatggagtctcgctctgtcccctaggctggagtgcagtggtgtgatctcagttcgctgcaacttccacctcctgggttcaagcgattctcctgcctcagcctcctgagtagctgggattacaggtgtacgccac

SEQ ID NO: 7835 - DNA, 1368 bp, Homo sapiens
agtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgttgctttggccttgagtgattttttttttttttttaaaccaggagtttgtcttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggattctaatgtgagatgctgagacctctgtggggagagggcagctatgctgttagctgctgttagatttaggagttgggtcatggattgt

SEQ ID NO: 7836 - DNA, 1332 bp, Homo sapiens
cagagcagctgctgttctgtctgctgggcagagggctgggttcctccgaggtaggcaggggcctcaacccagagcccctctcacaccctctctccaactcaggcttatgtctctccctcctcccccacccccaccccaggaagaggagatcccagaactggagattgacgtggatgagctcctggacatggagagtgacgatgcccgggctgccagggtcaaggtgagggggctggggggcgatgggttgcctgaggcactgccccgggaaagtgaggctgtggagccaggccctcaagccccagctcctgcctcaacagaatggggccaatgcctagctgtgaggttgttgtggcatctcctgtgcctcagggtggccccagtctcttggaagtgggtataggcgagctccaggcccccactcctgaggactcacttatccttcctcccccatcctctgctaggagctgctggttgactgttacaaacccacagaggtaagagatttcctggggggctggcgggggtggcagggtgaggggagcccggctcctgtcatcttggggtctggtctccttaatgtttaccctcccaccccatccaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagctaacaggctcggctggtctcttttaggggggcacactgctctttgacttctgccagctcagcttctccccaggtgaccacaggccttcctaagggccacgtagccatgacgatagcccagtgctggctcccagaccaggagttgaaagtggctggggagctgtgggggtggggggagcagtattgctgttggcaggcaggaacactcctttctctctgggcaagggccaccatgtcattgagcctagacccccaaggctccacagtcgggaaaggagaaggtggtggggtatgctggagctgaggtctctgagtctctcagggcccacaaacacacacaggcttactccttgggcttttaagtgtttttttgtttgtttttgttttt

SEQ ID NO: 7837 - DNA, 1153 bp, Homo sapiens
ctgtgaagatgagggctgctcctgggagcacagccggggtgagagcaccaggtaggagccgtggcactgcctcagtacccctgccctacccgcccaccccgctggctccatcaagctatgggggaccgagatagccgggtcttgccttccacccctgccatggcctttgcttccccatctgtactaggtgaggtcccctgggttcctattgctaaagcctccacctcttgcctagagatgtactttgtcctgggccccgaaggtctaggtcacaggggttctgttctaagcctgtcttcctcctgcagctcttgtgactgtggccctggtcactgtcctgagactgaccctgtttctctgctgcagtatgtcgggcagtctaggctctgggagctggtatggtgccatcgggcgtgagccgggctggtatgggggcagccagacgaagaccactcctctgctcttctcccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgccccacagttgtgcacctgtctgtcatctgccttgtgttcctatcacttttgcctgtttggcctaaggctgaacagacactagcccttgaagtgggctgctaggctgggcaggggtgacttaccccatcaaggctggtgggctgggagaggaggggcctgcagtttgcaagggaaggagaccacacaggcctttgttctcaaagctctcctggcccagaattgccccactacctccagatccctctccacttgaacagttgctactctttcctcaagacctgcgtcaactgttacctcctttaggaagccttctgtctcctggtcaagggacatgg

SEQ ID NO: 7838 - DNA, 1118 bp, Homo sapiens
gcagctggcctgggggaactgggggctgccctgctgcaactagtgcggcggctgcaggccctgcggctggagcgagaggagtatgttctactaaaggccttggcccttgccaattcaggtgagtctggggcaggcactgacaggtgaggtgtctccgtaaggtcttcaggttaactcagtgacggtagcacagccccattttgcagataacgaaaactgaggcttagggaagaacaatgacttgctagaagtcaaaaagcaagccaagtgcaggctccaaactgcacacaggattttgagccctagtgccacactaatgcagaaaggtcatttagtgggagggaaggtggggagggtacaaggtggccacagttgagggagagagggtggggtcctggcccacgagccgcagcaatgagtggtgcctctcagtcagccaatcaacaaatcctcgtttggctcttccttaggccccatccagcagtgctcaagatacggggagtgcccttgccagagatagcccaggccaacaccacattcctctcttcttgcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcaga

SEQ ID NO: 7839 - DNA, 1185 bp, Homo sapiens
cagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggcatctgcgtgtcctcgttcgtgttgtgggtgtctagagcagagattctgggcagacaggctgctagcccgtggagtttggaacctcagtggggagggacaggcagactcttctgggcaagaagatattctttgttccttgacttttgctatgagcaggagggcgcaactctcatcctgggtgtatatccggacagctctgctgggtatcatttaggatattcttggttgtaaatacagctgctgcttgacttagggtggacctacatcccgataaacccaacctgaatagaaaatgctgaaagccgaaaatacatttaatgtctgcaac

SEQ ID NO: 7840 - DNA, 1118 bp, Homo sapiens
gatctctgtccctagaggatggtagagtcccctggattctttgccctatcccagcatggcctgggcccctccctggaggggaggagaggacaggccaggctgggcactgtcctctactaggtgtgcccctggggtcccagctgtcagtgcagctgacctgaagggtgtggtgtaattaaagaatctctgagctgcaagggggttacctccttcagcatccctccccaccccatgaatcacccatacactccctaccagtgggaggccttctacctcccacctccaagatccattctgatcattgagtggttctttcttagtgtcaccctgcccttctgaaattcccacttattgtgaaattcccacttattgtgaaattcccgttagttctgccccttggaatcaaacggagaaatctaactcccgtttgtgttttaaatcaggctaaatacacattgtatcccaaagccctttaatccctggggccatgggagggtacattgcctttccacctgaggctgatcagtaattatcaggggggctgctgggagccagctctgaaggagggctatgacagagtgcatgctgccactctgtgatgtcacttctgagacagatgcctgggagccttgggcccactgtctccaacccacagggcctgggcggggaaggaacccaggtgaggcagggctgggaagccagtgttctttcccctgagttcctttccatgcagactgctttgtcttacctccccaacacgtgttcatactacgaccctgctctctctgtccagccagggccttcgtgggtctgtgccacgaagaccactcacttctgcctattccctgcacttgaggcacaggtcactagttaacaggttactagttagtgccccctgaactttggtgaatgtgtatgttgaagaggctgggtttctcctgctcactctcagtctctggctttcttctggatggggctggcttccctctgggtgcccatcttcaagtcgtttgctcttgcaaaccctactggagcctgtgtttctgagggtggagtctctgcaggggtgggcctggagctgacacctcttctctggacagatggaccccccattcctg

SEQ ID NO: 7841 - DNA, 2704 bp, Homo sapiens
agacagccgcggtgtgcccccgcgcgtgtgaccttgggcttctttaccaccccagatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggtctgcttctttattttctttttaatgcctgccccgcccggtttttcttttcacataaacttcctctaccaccagcagcagcagcagcaccaaaggtgccttaactttcgttcagcaccaggtccgggggggtgagactgtgggtggttaattagggaagcccaccacctgcctcctgtgtgtggctttggtggtgggagctcagtgtgtgggtggctccacagtctcccctttggtgactagttaacatcgctgagaaccaattttgcccctccttgttcactgctcatttttctagtctctgtcctttgaaggctttttcctggggctcagacgtccacgtttgatgagctccagtggtgatttgtgcctggaagctgccacctaaggccctgggcctggggaggcatcaacactaaaggtcaagccaactaatcctgcctgtcaggcacagagcagctaaaattaaaaccgccaagtggcttttttccttctctgctggtgacttgcagcctgccagcgctgtaggctttggcgggggtcggggggacaggataaagtgccccatcttgtgctttgcaagcacttttcaaagggtcttctgctttttttccatgtcttgggcggcgagtgggtagttactgttagggttccagaaaaatccatgtggagtctccaccaggtagtgaggtcctctcctgggcagaggtgccttagagctgccctggttccacctgcctctccttccttcagggcggctgagggacagtaggctcccccagcatctggctgctggggccagcaactggcctgggctgctttccagctgtgagctagggctggctactgctgtttactggggtgtctggtcccccgtccaggaggcctgtgctttgctatgggtctgccaggcttgaggagccctcagaagcaaggcaggctcagtgcgtttccccagccaagccctaaacttcggctcaccaaaaggaggacatcttttttgcctttgtccttaagtggcagaatgggggcagggcctggggcctggctaccctctttgaccttggcttcacctcattgcttctcccacaagcttggtt

SEQ ID NO: 7842 - DNA, 1411 bp, Homo sapiens
tcctaccccttgacttccttttctttctcctgcaggtctcagaacggccccgaagcctccccctatcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtccaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatgtccccgtctctgcttagcgtctgggtgagaaaaacaggctgtgatccagaagaagggaagatagagaaggagggaaaggatgtaggcgaaggaggtgagagacaggataggaggaaggaagtggaggaggaggtgataggaattggaaggaggtagaagccgtgcagaggaagaggggagagggacgaaggaggagcgatgaagaagaggagggagacaaaaagagggatggaggagagagggagtctggagaacaaagggtcctttctctggggaggggtgcagtgggcggggctgacactgtcagccaatcctcccatcggggaagagaatcctggacagggacaggatggggagggtatttataagggctttttggtgggagatgggtacccagtgggggccactggagggtctccgggcacactctggcccttcccagaaagggggtcgtttttctcgaatcttcaaccagttgtgtattggaaactagggcgcattttactattgatcacagtcattatattgttattatattactatttttattaaacctccccccactgaagtgtggggggcaaaataagtatttatctcctcaaatgccacattcccaggagggacagaccctgatgctctgtgaggcgcaagaaaccaataaagatgccgggcgcggtggctcacgcctgtaatcccagcactttgggaggccgaggcgggcagatcccgaggtcaggagattgagaccatcctggctaacacggtgaaaccccatctctactaaaaatacaaaaaattagccgggcgtggtgacgggtgcctgtagtccctgctactcgggaggctgaggcaggagaatggcgtgaacccgggaggcggagcttgcagtgagccga

SEQ ID NO: 7843 - DNA, 1995 bp, Homo sapiens
aagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagcttcgggtgcttccttgtcttttccaggggcagcagtcctgggccatcctcccctggtgtctgagggggtgatgccagcagggacagagtggcaaggcagccggggcaaggtgaccaaccctgcccagtcctgctctgctgggcagtagctgccccctcctactaagagggccaggcctgtagggaaaagggtttctggggtgatgcccccttccctgagcaaggtgggagctgagcagttcacttggggtggggaggggggaaacagttgggaggatgttgatagctgaggcctaggctggcacccctcagccaca

SEQ ID NO: 7844 - DNA, 1300 bp, Homo sapiens
caagtcagtgctttcagtatgctctgctccttgcatggattaactcatttcattctcacaaccacctcatgaggtgagaactattattttacagatggtgaagcaggctcacagaggttaggtaacttgtcccaggtcacacagccactaaatagacaggaagcctgtgtctgaccccagagcccacattttaaccatgattctagtgctcaagcaccacagtgagaaagagcagggttaaaatcttggctctgccacttatgagctatgttcccctaggcaggttgcttaacctctctgaactttggtttcctccttggtgaaatggtcgacacaatccctggctcatgagggcttgaggagaatgagtgagagagggtgtgtggggctcctagcacgatgcccggatcctggtggatgctcaggagcccatgctgcatttacatcactaaggggcagcactggcatggaactggacagagagcccaggtgcccctggggtctgacaaactctccctgggaccggcggggcttcctggatgggatgacatggagcagggccttgaggaaggcgtggagttcctctgggctggggagggaaggggctgacggcaggcagggtctgcagtcactggccaccaccatcagcacctttgtcctcccaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgattcctggctgagtcatttgttgattcaacagcgttagagaccacctgggaccctcaatctagcaggggacagaaaggaatggatcattggagtcgatggtgaactgtggctatgtcaaagggatgcagaaaaagttatagaagcatgggacacggtgcaactgattccatc

SEQ ID NO: 7845 - DNA, 1186 bp, Homo sapiens
agtgttgtaagtaaggatctggactgcaggaagtcaagagcctgaggccactcattcaaatataggttggggaaggagccaaaggctggcccttagaggggagagggaagttgggctaggcctagagaaggggcgtggtcgaggagagaggaaggacagggtgttgggaggggagatgagcctgatcctgtaaggaccaggcgtcctcattctggcttcccgctctcacaggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccagtcactagatgtgatttatttgaggggctgttgtagggagttaggatacacagcatgcagggagaggaacgcagactagccaaggcctaaggtaccccaagactcactttcgccactggtccttggccttgatgacctgagttggcatctgaggttggcacgcatcccatctccacccacctgccaccaagggcagttggtggttttgccatcccatccctgtcccctgctgcccaccctctgccacctaagcaccaggatgagggtgagttgcattagggcttgccactcccctcagggacctcaagctgttgcctgagaagcttgagagggtcctgtggtagtgcc

SEQ ID NO: 7846 - DNA, 1180 bp, Homo sapiens
ctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagaga

SEQ ID NO: 7847 - DNA, 1135 bp, Homo sapiens
tcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaattt

SEQ ID NO: 7848 - DNA, 1235 bp, Homo sapiens
ccttcttctaagctgttgtccacgcagcactcgagccaccttttagagtcctaatgcagtcacatgcctcctcgctgcaagctgtgggagggttcttaccctttgcttcagtccacacgccctagtccctggccggctcctgggagctctgcggcctccctgggtctccgtgtttcctagagcctccgtaagtgctccctgtccgcagatgcgtggggcccttcctcacctctgctctggggtgccctccgcctggcttctgcttctcagcagcttcccagggcagccccttcgggtctcagcgcataggtcccctactctgatctactcctgcttgcttttttttgcagttgctctgctcgctaacctaacggacttgctcagacttaagcctctagtttccaaatgcaggccgtgagggcatggaccgagcctggcccagcctgcccatcaccctgcatgttccaggtgctcaataatatttgttgaatgaatgaatgcgtgcacagggacgtgctgaggaggcttgggggccaattggctctgccccgccctgcctctgatccccgcctcctcacctgcccgcagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtcaggagggtggatcaccggtggatctcactgagcaggcagaggacctggcgcccccgacccgcagtgcaggcgggcttccaccagggggcgccagggaccatgcccttccccacaaattcccctccactccccccaccatcctgagggctgggaaatctcagcctccaggaggcacctgctgaggccctctggccgaaagagaggaagggggttggctcagggaagggagattctgggattcacctcacgcttagagggcggcctgctgctcttggaggagggagctggctcagctgatgcctgggagtactgagccctccgtcttggaagctgtgagcagaagctggcaggggaaagataggggatagggagggcctgtcggccaaggtgaggctgtgccagtcgctctgggattagaactccttgctcttgccctgtatctgccctgcttcacacactgccctcaag

SEQ ID NO: 7849 - DNA, 2070 bp, Homo sapiens
caaaaaaaattagaagaattcagccatagtcaatattaataaacaaggaatgacccaattgtttttcatataagggacaattattttgtgttttttagtgaaactacacaagtcttaaaactgaggtgcttgacaaacttctgtcttcccaggccctcttcctactcccaaaacttctgatttaatagggccaagagggcctgggcatcagtattctgaagtcctctagatgattatttctttcatctccatagaggatgatatttcataatatttgaagacttagaggtttatcccagctcaggaaaccatggaactttcctgctgcagagcatccctcgtcctacctgtagctgatcctgctatagagatggggtatcaagagcagaggaattgcaagcaggtggggattgtgtgggacccatcctgaccccattttgcctctctgcaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtctt

SEQ ID NO: 7850 - DNA, 1297 bp, Homo sapiens
ggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggaca

SEQ ID NO: 7851 - DNA, 2803 bp, Homo sapiens
gagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttaga

SEQ ID NO: 7852 - DNA, 1120 bp, Homo sapiens
ggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcaga

SEQ ID NO: 7853 - DNA, 1169 bp, Homo sapiens
aaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaa

SEQ ID NO: 7854 - DNA, 1096 bp, Homo sapiens
ctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctc

SEQ ID NO: 7855 - DNA, 1214 bp, Homo sapiens
gtgggcagaaggggcagggctgccaagccaggaagctggtgggcacagagcacagggcgccggtcccagtcagtgggacctgccatgcccctgggcctggaggttgcccctggcaggccacagaggcccactgtgacctggccccagcctgcctccactgggactgcccatccatctttcgggtctggggtcgctggctgccattgggctttgctgccgcttcctccacctgcactgccctcccctcccagtgcccatcttgtgaaaggccagaatgtgggtatgtgatggggaggccatgggacctgtgggaccagggaagatgctagtagagggcagaactcagtccttgttccaagaccacggagaggtcttgggccctcacccggaatatgcaccagccacaccctcacctgtgccgcctctgcccgcaggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggtgagtggcctgaagccggcctgcttcacatatgggagacgggggttcccagggagggaggagtggctggtggggacatgcaaggaggcaaggccgagaccacagtcatcagctggaccctgaaccaggcattcggggtactgaagacgcatgtagggagcagagttctaagttcagctatcaggtggtccaggcaggtgggggcgatgcctgctgtgaaataaaagaagtaatcgggccaggcagtggtgcacgcctgtgatcccagcactctgggaggatcacgtgagccttgaaaggttgaggctgcagtgagcggtgatcatgacactggactccagcctgggcgacacagcatacatgtaatcataatcgtagcaaactcctggctccttacttgtgcca

SEQ ID NO: 7856 - DNA, 2273 bp, Homo sapiens
aggagctgagcaagagcttcctgaccctgacccagcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggaggtgagtgcttgctctagaggcaggggctgggggacgtgagctacgggcttggggttgggcaaagggcaggtaagaatggacctggtcagtgtcagctcagcctcggttgtaggcagcagatggacgtgggcctggtggtgattgacattgtctgccaaacctcttagacatggggctcagccacctggctccacatccttgattagcacctgagtctctgtcccctgaggactctcatcatccacactcatcctcccaccaccagtggggtggggcagggccgatcagtgtcatccttgtttgcaagtaaggaaactgagcatggggctgtgtgacctggctgggcctcagagccggggcgtggttgtactaggcctttagctccctggcggaacaccgtccccaaccttactcccccagccttgtctgagcatctgtcacttacacttgggggcctctctctgggcagcggccgaggagactggcaggcgggaccgctcaagcagtgtgaggcggacccaggccattcggagacgccacaatgcaggcagcaaccccacccctccagcctctgtcatgggctcgccgcccaggtgagcaccttgccagctgtgccgaggggcaccgggggccggggagggcccgcaagctctagctggcgctgacctggggctgaccctctccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgctgtgcactatttctacgatgagagcggtgagcctttcccaagcccggtggcccagtgcctccccgccttcccccaacagcctgagtcctcctagcagtggtgctcgctcggccctgtggcaggtacactgctaatgctgccagacatcatccttgcagcctctttgaggcacggtgtctctgtcatcttttgctctgctgatgaggaaacagaggctcagcttacagtacaggggagatctaaagctaggacaggtgactgccgcgcccaggctcttgacctgtaggccctttcctctccagaggctgggctgccctctcagaggacacagcacaaggttctgcctcatttgatgggtctggtgcccacgtgagccgggccttggtgcttctgtctctgccacgctgcctcatctcccataccctgccccaggtgtgcggcgttcctacacctttggcctggctggag

SEQ ID NO: 7857 - DNA, 1141 bp, Homo sapiens
cagagcgtgcagcctgatgcggcgtcccccatgcacgtgagtacccatggagcagcgcctctggccaggaggccccgggaggggctgagaccaggtggggaggagggtagggtatggagggctggggctccctcaccacccccatcacccccacctggccaggctctccagcttggacccagggccaggcctggggcccttgagtgtgtgcatgtgtcagaggtgtggccagtcggggagacccagctcctcatgggctgacccctcagggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactggtgaggctggggcagggatgaggtggcccaggagagtgagtccccgagggtgggccgcggaaagccagcaggctgaccaggccttcgtgtcccctccctgccagtgttcaccctgtgcttccccttcgtcttcctcctgggcctcctgccccaggtcaacacctgcctcatgtacctgctggagcaaatagatatgcacggcttcgggggcacaggtatgatgcccacaggtggctcagggatggggcccgtgtggaggcccaggagggccctcggattgggtccttggctccacccttgcggaaccttctcctgcgtctgtactgcagactcaaggtttctgccttctcccctctccttccctccccaggcaagtggtttatatctgagaatcttggaagctctaaaggccgcttggggcttggggcagcagagaacaatgggctgggggtgcctttccagggaggccagcctctgggagttgaggggaagcgcggctagggttgaggtggggtacctgcaagtgagagctgggctgtacttctcccttccacacagctgccaccagcccgctcacggcagtcttcagcctctcccgcagcctgctggctgctgccctgctctacggtttctgccttggggccatcaaggtaggggtggcttgcgaggtgggggcatgctgcagtgcgtaagggtggtt

SEQ ID NO: 7858 - DNA, 1184 bp, Homo sapiens
tcctcagggaaggcaggcatgtggaagccaggtgcagagtcctggcctctccacacaggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctagtgaggaccaccccaccctcaacgatcccatcatccgctttcccttttgatccgtggggaaactgaggcctagagagggaatgaatcatgtctaaggttgtttagcaagctaaagcaggaccccagctcctgacacgccatcccaggaagtggttgcttcttcaaaggcaaatgtgttcccaccactccctttggaagagcagagactaagagtcacgggcccaaaagagcagggaccagcccagcagagcagaggccaggggttgctctccggccagagtaggcgagggatgggacacctatacccactgccccggtcccctaccaagcacccgatgcctgccccttgcccacagctgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaaggtgagttggtggctgtggcccagaccccaggctgtccaatgggagcagagccaacttctgcctgggtgggaagagaatttcctgagggcctgtggccaccgctctgtatcagccccgtgggcctttgcagcagcctctcaaggaaggggttacttccaccctctacagagaggaagcaggctgaaggaggttgagggacttgcctcaggcttccagagaattggtggtcagccaggatttgaacccaggcctgtctgaccccacgaccacctcctcagaaatggttagggtaatcaggacctggccttatcctctggacgcagacctctgagttccacgctcttttgccaccctggatccagagcagtccgagctgagtttcagaagcccctagtgcctgggtgtgtataggtgctctgccggctgtggcattgccacggcttgggg

SEQ ID NO: 7859 - DNA, 1135 bp, Homo sapiens
cccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttggttggcagtttctttttctacctgggaatgggtacatgatagtacaggcggctaagttgggatggacaagcacgcagaggggtgaaggatgtggggctgaagtctagtagagatcaagggcagaccaaggtggggttcaggtagaaccgggtcctcttcaccgcatggctgctcccttttcaagcctttatctgaagggtattgtctgccatttcccaccatatggtcagacttccaggtctggtggctcctacatttatcaggcttgttcttggccaaagcctttctctgcacctcagctgctccagggcgtaaagagatgacacctatctaaggtgtttttagaataaatgagagcgcgctagtggaatggttgcccagggcccagtgcttagcaagtgctccataaaatagtggcagactcttgagcacct

SEQ ID NO: 7860 - DNA, 1200 bp, Homo sapiens
gccccttcccaaagacagaaacaccctaggtcttcaccaggggcagtgggggagccattggtgccttggctttctcctgcctgaatgaggaggggtttggggcacagaagacctcatcacgagcccctactatccaacccctagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacaggtgggcaccggagtggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcaggtgagctggagtggtaaactggggcccctgcgcgcggcggggcggagcctgctttggacccctccctcccgccgcctttgtcccctactcctgcggaagggaaagtcgaggagggcagagccagccccggggcttggcaaggccggaactggtgccctcgggtaagcgacttctggtcttcatccctcgggcggtggcacacgcggccctc

SEQ ID NO: 7861 - DNA, 1195 bp, Homo sapiens
atcccagcactttgggagtccaaccaaggctggtggatcacctgaggtcaggagtttgagaccagcctggccaacatggtgaaaccttgtttctactagaaatacaaaaattagccaggcgtggtggcgggtgcctgtaatccagctcggaaagctgaggcaggagaactgcttgaaccccggaggtggagattgcagtgagccaagatcgcgctactgccctccagcctgggcgacagactgagactccatctaaaaaatggggtcattgggtgatcttttccacatcatcgatcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagt

SEQ ID NO: 7862 - DNA, 1450 bp, Homo sapiens
cgtgtttctgtccagggcccccgagtctgcgccccttaagagcaaaatgatttatgccagctccaaggacgccatcaagaagaagctgacaggtaagggccagcattggtgctgagtgcccttctgctctggccttggctgcagggcagggtgaatggcacgcagagggggtctgcccccttgtcttcgctgcctgcttgttccttccatctgctttgattggctccttcccagccacagaaactacccccaccccagtgcttcctgctcacagatgctcccctttcttctttatagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatgggatgtgtttttcaaggttgggacacaggagacttcaggattgggggtgcactgggataatggtgctatctctctcctctgtactccacacccaaccagcccctgcacacccttatctggctccaatgactggctgagacgcctttctgatggtcaccattattctgttggtgctgtgattgacactggactggctgtttaaggagtgggtgctggctacaggggtcttccagcggaagtgatttatgcctgaactgggtgctctgtagccttgcctggatggacagtgaggtccatctgatattctgttctgtccctttctaggtgtgggctgataggcaagtcagaggtagctcaaaggttctgtttggtctgctgtcttccctggatggctgactcaagtttatgagggtcaggttcagtggctgctgtgagtcaggccaagttgagcctttgacctcctctagatgtggctggagtgcattcagggtggggccagccag

SEQ ID NO: 7863 - DNA, 1200 bp, Homo sapiens
aggaaggccctgtaggatgttgggtattcattcaaagggcatccaaacccattgatgggtttggagcagaagagtgaccccagtgaaagaggtgcagagtggagttaggcggcagatagcagctgggcctgcatgggctgtgggcgtggcctgtctggctgctgccagggaggacccttaggttcctgggtctcaatggcatcaccccagaaactgctgggtttgcccacagccgctccctcccccaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggtgcgtctggggcggccccgccctctgcttccctcggctgggtgggctggctggggcctgggccgaccctggtcttttgtgccccaggactttgaacgggatgaggagcgctcagccaacggtggctccgaatctgacggggaggagaacatcggctggagcacggtgaacctggacgaggagaagcagcagcaggatgtgagggccgcgccgctggggggtgggcgtttgggggtgctcaagctggagatgagcaccgggctcggtgtccagagcctcagcctcctcatccagagtgggctctgcagacctcccagggcgatctgaggagtaaatgaggaaattaaatgttgtggagggctggtgcctggcaggtggtgaccagtgggtggggctgagaagagccggtatggcctgctaaccacccccgccacgtgtcccgtagttctctgcttcctccaccaccatcctggacgaggaaccgatcgtgaatagggggctggcagctgccctgctcctgtgtcagaacaaaggtagggagctcagggcagccatgacttgggtgggcttgggtgctgctgcaggtgcaggcagggccccctccggtcccctctgctgcccctttctctcagtcccaatgctggagccagctgtccggcccagagccactccttcccctccactgtggcatctgtccgtctgctctgcctttgaggctccacacctgcttggggaaggagaggggagttgaaactgttccagctgtggcacagagagc

SEQ ID NO: 7864 - DNA, 1186 bp, Homo sapiens
tccaggcccttccagcactctcgtaggccgcccgaccgtcctgccctaccactcagctgcccccttgctctctggggtttgtctccctgcagccccagccccagccccagcgtccaggcccagcccctgcgtggcaggtctccaggttccccatgctctgcccccatggcagcgcatccactagccaagctggtctcccggcctctgctggggccctgcagggtgccagcgtctgtgctcttttcccatccccttcccactgcaccccaggcctggcattggggtcaatcaacacccgccctgttattatacaccttgtgggcacaggtggctccggccccacccagggccctgcatctcctctcatgccccgcgtccccaggctttccggcagctgtcgcaccgcttccatggcaagggctcaggcaagatgaagacagagcggcggatgaagaagctggacgaggaggcggtgggtgcccttggggatgtggggggccctgtgcctgccggggcaggggtggctggtgtgtggggcctgctgcagccctttctgagtggccccgacccctcagctcctgaagaagatgagctccagcgacacgcccctgggcaccgtggccctgctccaggagaagcagaaggctcagaagaccccctacatcgtgctcagcggcagcggcaagagcatgaacgcgtgagtggctcgaggctggtggggtagggtgtggtggggaggggtggcgtggcctgtgcccgcctctgcagcctcacgcccctgttcttctctgcaggaacaccatcaccaagtgacagcgccctcccgccccggccctgcctcaaccttcatattaaataaagctccctccttattttttcctccctggtcgtggtacagattccagggttggatctttggttgggtgtggcacagagtctggctcctgctaggtgagacctggccatcaaatgacacaaacaactaaacgatggaagagagagcgagcccgggtcctctaaggctccttccttctcccctggctgtcggtcacacctctgcagggccggctctctgatagaaagtggaaggcggttttagaaactcatcaccctgctctctcctggcctcgggggctgcacaggtcactgtcctgtaatgtctcccggtcagggcagcccaggactg

SEQ ID NO: 7865 - DNA, 1315 bp, Homo sapiens
atgggggagaagccagtggggagcctggctgggattggtgaagtcctgggcaagaagctggaggaaaggggttttgacaaggtgtggggtggctgcgtgtacctagtgcaagcggggggtggaagggaagtgattccatctgctgggggatggacagtaaggtataatctgaagaggctgccagagcctgggcacctggtggagaggagaggggggcaaaacccgcgctgcttcctgggcttgtgtgctctgaatggcacaggaatggctgtcttgctcttatctctcactgagcactgagcagcacgctccttccttttccctgttttgcaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcatgactgggctttgtgcactgaaaagcaagtgggctgggagttgcctctccttcagggactgaccatgtttccctcactccttatcagtagagaccgaaactggcagcttcccttccactcccagagggcagccaccctagccatgtaggcctcaggcaggtgacttttgtctcaatccccgagtgatgtgggagagggtgtgggtggatcttttcctgggagccagatggactgtgctccagatgtcagttaagtcaacagctgggctaggcagcacctggtggaaaagtcagtgggagtcagaggtaccagacagggtgggccggatgtgggtgagagttcacctgccagtcatcatctgctctcccggcctctgtaagggtgggcagggtgcttgccatcttccatgatctcttagggaggagaaggagcacaggcatcacagctggaaggatgtgagg

SEQ ID NO: 7866 - DNA, 1549 bp, Homo sapiens
gtatgaggagcatgtgcgggagcagcaggctcaagtagagaaggaggacttcagtgacatggtggctgagcacgctgccaaacagaaggtaggcgcttccaggggcgctgggctgggtgagagccagggaccctggcctgccgttttcagtggcatggtgccctctagtggtgagagtgagggtggcctctgcttgctgctctgtgcttccttagatttggaagtcttagaaatcctccagtgggctgccctctttaaggacgatgagggggaggaactcagccaagtctgagagggagctcgaagagaattcagattcagcgcctttcccacagacttctatgtctatgtcaggctgcccacccttgttttgggggtccgggggtggttcaacctgtcttaacctgtgtctctttctccctatacagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggagtaaaaatagccagattagcgccctagcgcggcagaggaagtaacagtgggcttgggaagtaggccagggcaggccttcccaactgaccttgtgaccagaagttcaagtccttacctgtgcgacaacatagctcaaaagctaaattgtcttgagtccatatgaacccttgggttcaagcaacactagtcgctggggtttgggatttgtatgtgggatggggggacttactttctccaggttgtaatctggtcctgagcagcctttctgacagactagagcaggctggatcactggctcccatgggcatttgccagcctgtggggagggtagtcatgcgctgctgttgtactactgttggtgtttaagtgcaccagtggaggcgctcacttgccggagggttcaagatggtctcggggttgtggggggcatgatccagataggacgtggcagctgagctaggccttaggaggaatggaattttagaaatttggtaagcaacaaagcactggcactctaaagaggcatttggggggtagggaaagaagaggaaggttggctccagatgggccccggggtagcttgagaattcacttatgcgaagaaccttctggactccaggtccctgagcccccgcttgccctc

SEQ ID NO: 7867 - DNA, 1274 bp, Homo sapiens
aggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgactgccttgggcttctatgccccctcactgtgccacaggagctgcccaaccccttttccacagtgcagcccaactccagtgaaaatccaccaggaacgtaggtggaaagaagcgtactcccatgttctcaatcatggaaacaggcatgaaggtgtctcacctggcatgaggcaggcagaggtcggaaacaggaaagatgtcatttccacaccaaaagcccgtttttccccaggacccaccatccccaaatccacctcccaaggcagtgacgtgttgagtgtggcttccccatcttctgatcaaaggtcagaacttagcttctctcccctgctccaggttggtgaagtccgagccagtggggtctttgcctctgcaggtggagggaatagggctgagggacatctgtggagttccttttcctgcccgcccttgacttagagatggaaagcagtggtagccactgt

SEQ ID NO: 7868 - DNA, 1804 bp, Homo sapiens
tgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaagttgtggtggccaagtgtggtctgtggtctaagcccagccttggggtggggggatggaactggaaccctgggcttggtggggtgcacgggggtcctggcttggtttctgtgtcctaaggctgctggcaaaagcccttgaccccgtttcctgaggccaggaaagctgcttgtgcttctgtggtctgtccccaagggcccagcaccgttctgtcagggaaagaggcaggcggccatcagctcatacctggcgtgccgccgccaactcccgcggggcacacggcagaggtgtggggtcgcgcagccgctgagagggcccccactgcacctggcccaacctccttcagcgccccccaaaaccccactgctcccattcagcccctgtcctggcgtcattgtgtgtcccagccaggtgcttctgccgtctccgacag

SEQ ID NO: 7869 - DNA, 1257 bp, Homo sapiens
cctttcacctgctggcctacagtggctacaaatacgtggggtgagcacttgtgggccagggggaggtggccttggatctgggcctgcatagctgtagcctcgaactgtgaccctggacatgtctcggcccctagtgacctctagcactgctctgttaagagggagcagctgtctccagcagtctcctgaggatctgcgtgccatgcagaggttggggaggtgttgagagtcactctgcgagtcttggggagagaagggggtctcagatccaggtcctggggctgagtcctgggccttccatatccctttggggtctgggtccctgtggggacagattgagagtaaaaggtgctgtgggaggtggggtctagctgggctctgggcgttgggggtagggccaatctcaggcctagacccctgggggtcaccaaccctttcctcctcccacccccagaatgatcctcagtgtgctcacggggctgctgttcggcagcgatggctactacgtggcgctggcctggacctcatcggcgctcatgtacttcattgtgagtctggtgcacccccccattcccctgccttcacttgagggcaaacctccccctcctggccaggcttcagttctcctttcttccaggtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttgactttgtctgacccttgttcctggggcctgatggggagctacagatacctctgcgcctctgcattgcccaggggatcgggcttggggccgtctaggaagaaggtggacccagggagggcttcatgactttggtgaccttgatactgccttgtaagggtttcagcagcctcagctgggaaagagaagatggaaggaggctgctgaggggacctggaaggcgtctgatccctctggggggctccagcagggtctgtgggctagtggggtgagacaagccaggctggggattcagcttagggctgccccctatacagtccctgtaatcggcccccatctcctcttcaagctttccaggagcagaaccggggcccacatatttgcagtagtttattcatattttgtcacaaatggccgggg

SEQ ID NO: 7870 - DNA, 1226 bp, Homo sapiens
tcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggaggtgtggcctgcccccggggcacgggtggcagaatttttggctagggctggggcatcatgggattccacccgattcctcacagtgccctcagggatggagcacacagaggggcaccctgaggcctggggtgcggcttgcccacagcttcctctctcccctcccagctgcaccgttttgtgtctgtgagcaaactcaagtatttttttgctgtggacacagcctacgtggccaagaagctagggctgctggtcttcccctacacacaccaggtgagcttcctaccaagggagctggtgggccttcctcattctgcccgagtctggcccccagacctcaacccccttctctcctcttttctcttcttcccctcctgatgtggccgctgctgccactgccactgccagaactgggaagtgcagtacagtcgtgatgctcctctgcccccccggcaagacctcaacgcccctgacctctatatccccagtgagtctccaacctgggctggggaacgtggtggggtggggtcgggggggacttgtgccttgagggatgaatgggaagagaggcgcagctactgagtcagcatctgttcttggtgctttgtgtatgtgtggcagttgcaagacaccaggcaggcagtgcagggtgaccagtaaggagcttcctgaatgcgccttcagtgtccccaggacacccttttgagaccttcctgtttcttgatttggactgtatccctccccagcctggagctctgggtttagacctggctttgcagactccagctatgggatttcaggctggttatttgtacttttcagtaaaacaggactaatgtagtccctaccccaaaggactgttggagagattcagcaaggtgatgtttgctcagcacctcacctggcacacaggaaggacgtaggaaacattaactcttatcatcgttattgcttgtcctccaaggcgtgctctgttatcccttcttccaagaagcctttcctgaccccctgagcaagtggtggctcccttctgggttcccacaactgcctgtcca

SEQ ID NO: 7871 - DNA, 1202 bp, Homo sapiens
ctgtgtcccctcagaagagaaaatcggatggtaagaaccatggctgttgcatggccttccctgcccccttgccatcacctttcctcagctcagcttccaggaaggagcccagagaaaggctgtgactgtgtcagaatcagtggctcaagaaagttaggatggtctagatttgaggggcttgtgggagtttgaggagcaggaaccaggatggggctggggaagctctgggttgatggagctcccactcaggaggggtcagggagggctgtggagctgcccaggaggcctgttctgggccagcccaaagccactcagtaagtggctgcctccttcctttcagcttcctaactggtgacagttttcttcttcccacatatgcacaggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggactctggcgtgccctgtgtgtgtgtgtgatttaccttgcaagagaatcagggctcccgtggggagcacctgaaccaggccgacttctagggtgcctgcagattgccactcctcacactacccagcagaggctagagcactgtgcgtggggccaggctggggagggggaggtgggcgctgggctgcctggcgctgggcagagtcaacatatggcaccgggagagtgcctcggcggggagggtggatgcgtgtgcttggagcctgggtcat

SEQ ID NO: 7872 - DNA, 1116 bp, Homo sapiens
tcggagctaaaggagaagtgagcgtggggacaccttgggctgggtctgcgaggatctgggatgaggaggtggtgggcctggtactgggcaggcgtggttggtgcccaggaagtgcgcgcctaacaccgggcttgctgtggaatgggtgctgggtatgtgtttgcccaagagcgatgggtgagcaaatgggtgcacggctgcctttttaccacgcaggttgttcagggaacgactgagtcagctgcggttgcggctggaggaagtgggggctgagagagcccctgaatacacggagccccttggggggctgcagcggagcctcaagattcgcattcaggtggcaggtctgtgggtggttctgtaccctcttcccctcccagaacccgtggcaccctgtccccttcctctctcgttcctgcccggccttgccctttgctctcagccctcctatgtgggcaccgggctccccagccaagcagggaccctcctccctttctctgcagggatctacaagggcttctgtctggatgtgatcaggaataagtacgaatgtgagctgcagggagccaaacagcacctggaggtgggcctgattgggcacactgggggtgaggcagggcacaaagcctgaagtggcctcaccccatccgtcctgctgagctattgccccctcttccagagtgagaagctgctgctctatgacacgctgcagggggagctgcaggagcggatccagaggctggaggaggaccgccagagcctggacctcagctctggtaagcgcgagagcctgggcaccccggaactgggccccgctcagtccacgcccacccctctttgggcttcagatgtcctgaagtcaaggggacagccagaggacctgcctgttggggtcagtgtgagggctgaaggagaccaggcctggaaagggcctggcacataatgggggctcaagcagagtgggtctccctgcctcttctgcccctgctctttccaaaacaggtatcagtgtgacatgcagtcacatgcaatagctctagtcccctccatgttcatagtacctgtgttcacgtggagtcctggggtggcaggaattgtcgtcatcccactctccac

SEQ ID NO: 7873 - DNA, 1245 bp, Homo sapiens
gcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtccc

SEQ ID NO: 7874 - DNA, 1307 bp, Homo sapiens
gtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccagacaccgggctctgcttcttggaggttttgttatttaatcctcatagtaacccaagaagggaggtgttgccatttttgtctctgaggagatgagggcagatgcaccaagtcacacaactagaaagtggccaagccaggatttgaatccacagctgctcctctccatcacagtgttgctttccttcaacagaggtgggggtgaaccaagcagggttttggatactagattggtggacacccacctgcttcgtgcccagccctgcgcagggcccctgcagtgggcaaggccgggcctcttgcagcccatggtctgcagagggacctacccgtgcttgtgttggaagctggcccccacacctgtgctggccacctgtaccccaggccaggatgcagtgggctattagccaggctggaagtgttcagaggagtgagaaccaggggctctagaaggcccagggaggacctggagcctgagccaagtcttgaatggcagagcatctccagaggcagagaggagttgggagggcagcccaggtgaggggaacagcatggtgtggcagggaacatgcctggtgtggaggggggcagcaaaaaggaatggggggtagggaaggttgctggggcctggtgggccttgattgccatgga

SEQ ID NO: 7875 - DNA, 1828 bp, Homo sapiens
gagattcctgacccctgctgtgtgggctgttgtgaggagtaaaggtgaagacagtaagccctaacacacagtaagccctgacagcaaacaggtgttagtgttgagagacagcgtccacggaggttgtgtgctctgactccagtgtggggctcttaggctctgagcctcagtttcctcatctgtgaagtggggtgatagtggcactgtcctcggaagatggttgtgaggattcaaaggatgctgcatgaaagacgcatggcatgcagtgggagggtgagaatgacaccgtggcctcctctggcagtgccaggagcccgtggtgggcacagctgggctgtctggcctacccattggggcatctcccactggggtctggagacaccagatctgggtcctcacaggacttggggcaagtccctcggctgtctggtcctcagttttcctctctgtgtggtggggtaggcagctcaggttctcaggctcccaatggctctgaggaggcagccagcgtcacagggctcagggctgtgcaggcgtcagtgtgtggacagacctgctgctcccgccgcccgctcctgcgctcccgcttgccttcctgagccactttccggcctgtggattctggggctggaggcctggatccagttgggggcgcctttccctcacccaccgtgtgttctgcaggacgaaaaaggagcattcaactttgaccaggaaacagtgatcaacccagagacgggcgagcaggtgagggaggcctcagcagagccccagggtactgggagggtgggcacaggtggggcagtggccaccttaagcccgacagtggagctccttttccagattcagagctggtatcggagcggggagacctgggatagcaagttcagcaccatcgcctccagctacgaagagtgccgggctgagagcgtgggtctctacctctgtctccacccgcaagtgctggagtaagagcagcagggccgaggggcgggctgtcccgctgcagtggccagccctgggggcgtggagggtgggtggtagtggccagtgggatggggacagggcagcctctgaccatcctgccacctgcctgcccctctcacaggatctttggctttgagggggctgatgcggaggacgtgatctacgtgaactggctcaacatggttcgggccgggctgctcgctctggagttctacacacctgaggccttcaactggcgacaggtagggcctaggtggagccccctggaggcggaagggagcctgcagtgggtgccaagatcagggtgcaaggatgggaccactgtacctttaaggcagatgaactgggtttaatgctagactccactgtttgggaggcaagtcacatcactcttgtgagccccagagttcctctctgtgaaatgggagtaggactctccccggccaccatttcacggtgaatcagatgaggtgactttattaggactcctcgcagttgacgcactctctgccacacacaattctaaacgccctccatgaattaactaccccaggaggtaggtgctattgttaccctcattttagagatgaggaagtcgaggcacaaggagatgaagcaacttgccactaagtggcagagccaggattcgcatccatacagtgcctacagggccattcagtgccacggctcagttatgtgtcctttggatatggggtaagcaatagaaacttttttgtttgttcgtttttgtttttttgagacaaagtctcgctctgtcaccaggctggagtgcagtggccggatctcggctcactgcaacctccgcctcccgggttcaagc

SEQ ID NO: 7876 - DNA, 1475 bp, Homo sapiens
tacaggctcatgccaccacgcccagctaatttttttgtatgtttagtataaacagtgtttcatcatgttggccaagctggtctcaaactcctgacctcaggtgatcctcccacctcagcctaccaaggtgctaggattacaggcatgagccaccatgcccagcctaaatctttatttgattgactgaatgaacgaaagcagcaatgcatttaatactccccctgtagtatttccttcctcacagggttactgtaaagagtaaattaagtaattaacctaaaacgtagagcacaggtttttttggcagagctcagtaagaaacagctgctgctgtaattgtgattattaagatttttatgatgattcagtttccctattcagacctttccctgctgttttctctccatctcctccccaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccatctttgcggcgtgtgtggctcctccttgcctttgcctgtcttctcatttactcccagcagagtgatgggctcaaggcctggggagggggcaaggagggccatttttagcctcccttccacaacaggatgttgacattatctctagatgaggatacgcagtcacagagctgaacatagcacaatttttgcagctctcctttgtggcattccttgcatttttaaatgttctggggccgggcacggtggctcatgcctgtaatcccagcactttgggaggccgaggcgaggggatcacgaggtcaggagttcgagaccggcttggccaatatggtgaaacctcgtctctactaaaaaataaagtagctgggcatggtggcatgcgcctgtaatcccagctactcgggaggctgaggcaggagaatccctggaacccgggaggcggaggttgcggtgagccgaaatcgcgctactgcgctcc

SEQ ID NO: 7877 - DNA, 1212 bp, Homo sapiens
agcaaatctgcttcctgctgtgggtaggatgcagatttcagcctaccataaaggacttcctacagccagggctaaggtctctggaggaagggaactcccttgttactggggctctgctagctgaggttggacagtccccaggaggggacactgggagccctcctggctttagtgctcatgggcatagtgcctggcctctatccctgcagggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaaggtgagtcccaggcggtggaggggctggtgggctagggcagggcacgggacctgtgggtcctcaacgcctcttctccccagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtctctccccatctccttttagttcctgaagcagaagctggcccctcaggctcctgggcaggaccagctatcccaccttgacccgccaggagtccctgccatctctcctcacccccggggactgagcatttataccacactcgggacaaggacacctctttattgctgttagaaaagggtggttacaagtttcctggacatggagagggacactatccctaaatccaagggaaccagaaaatttatagtatcaaacagaggaaagcgggggcagaacagagctgggcttaagatcagaaaattttcttcctgctcattacccaagcccagagttcttgccccagcttcaactgccaagataccacccttcaccccgacatcctcctaagctaccacaattcaacaaaggtgcaggtgcagaacttcagggtgggaatggggtgcagggaagcaggggctgtgccccagcccagtg

SEQ ID NO: 7878 - DNA, 1194 bp, Homo sapiens
ccccatctctcccagcctcagatgtgtcatttctagaatgaagacattcttcagaggggatggcctgtggcctggggtggacgaggaatgtgaaacctcgcgtagagggcttagttcatttctggctgtgaatggcaaatgggagcctgcccttctctactcacccccaccgttccccaggagggctggagacagaggatgactacagctaccagggtcacatgcagtcctgcaacttctcagcagagaaggccaaggtctacatcaatgactccgtggagctgagccagaacgagcagagtgagtgaggggcagggtgaggtgaggtcaggtggggccggggcctgggtgcctactgatgccaccccttcccatctcagagctggcagcctggctggccaagagaggcccaatctccgtggccatcaatgcctttggcatgcaggtgaggccctagccccactgcccctgccccatctcttgttgacctccccgacctcttcttggagtcgatcccctactccttctccacctccagttttaccgccacgggatctcccgccctctccggcccctctgcagcccttggctcattgaccatgcggtgttgcttgtgggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcccctggccctccagccgccatcctaccctggtgccctcaccagctccccctctcccccagggttactactacttg

SEQ ID NO: 7879 - DNA, 2116 bp, Homo sapiens
gccttggaggtagctggcaacagctgggtgctgttgtgtgtccaatttgggacccatcaggtagcatgccctgcccccctaattgctaaccctctgtctgctgctttatcagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtagtccctttggcattcactggctaaaggcaagtttacgaggtgcgtccactctgggaagttggggacctcgctttcatccgccgttctgttgataaacaaccaaggtctttctctgcagggcccaggggcggagatagtttgctgtggtgtgggaatgtagacca

SEQ ID NO: 7880 - DNA, 2555 bp, Homo sapiens
agggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctggttgtcattgtcttgattgcattcagtgtcaaaggagccaatttgacatccaggaagacatgatagctaaagggaaggcagtcagagaacccaggactggtgaggaaaggggtttgaatgtcggaattagaaggattgccctgtggcccagaaggatttagctcatcgtcgtcctgctagcctgccatctttcagactttccagggcaggtggcctggtcctcagccctcaacttgagttagtcacaccaaaatgcagtaaatgatgcccattttcctctgcctgtgcttgaccattttcactgacttttctccagttcaggaataacctgtgttccaatgggatggttctggggtttggcctcttaggaagtggggaatgggctgctgtggtatttacaggctagtagatcctttaggcagtaggctggaatgagtgctggggctgggacccagaaaggaaccagtagtggagtgggggtaatggcgttgcctgatactgccctatggttggaataaggaagggcagagaaaacttgaagcaggtatggggcattctggccatagagctcgtattttgcctgttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatct

SEQ ID NO: 7881 - DNA, 1229 bp, Homo sapiens
ctccgggactctcaaggctacagtgtggactgctggcccaaggagaaggttggtttcctgaagtggtgggtggtgggttggggggggtcttcgttgtttttcttccctggcatgtgcctgcataagctatttccacagcgtcctggccgcgagggggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgagggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggtaagccgggagcagcccttcccccaccgccccctgagaataccttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtg

SEQ ID NO: 7882 - DNA, 1578 bp, Homo sapiens
ttttttgaggagggtggagaactggcctttacttatattcctttgcttaatgaaaatccatcttgctagtaaggattggaggtgtcagaaaagacttgggcactgtttcttactttgacttcttttgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaatctatatgttgagtcttttttttttttcctttttatcttttcctaaagatgagtcctgcattagaattgtctagataaagccattgctatgaccagtgtctggggtaggggctggggctatgactaagagtgatagcaacccttcttgcgtctgtttcttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgaccc

SEQ ID NO: 7883 - DNA, 1578 bp, Homo sapiens; identical to SEQ ID NO: 7882

SEQ ID NO: 7884 - DNA, 1415 bp, Homo sapiens
cttaaaacttgtgcagttgatgctacttctatctagactttgaatgatttttaactcggaccttggcagtaactcctagatagaaaatactgttaattttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaagatttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttagggtatgtgtgctttgcgagacttcttgcttgggcttgtttgggggttcatttgtaccttgaaggggagggtataaagttttaagacactcagctttgggtgaacgtcactgtagttattttgtttattgtaagtaggacttgtaggtgccagaggaaggaggttatacagaagcccaggcaggcagccttattccaatgaagacttttcccactggtccacctttgttataaaaccaactacttttagtttacagatgtaggtcttctcttctagagaaacagtcaccaccttcccttaagactaccattccaatcacccagtcagtgtatctagcttaacttaatttccagggaaaaggaggggtttaggggaagaggaagtcagttttcgctcttcgtgccatgtgaaaaaatgaagctgtggctccaagagtactttgctaactaggccagtgacatgtgttgatgcctttcaccatctatttgttt

SEQ ID NO: 7885 - DNA, 1415 bp, Homo sapiens; identical to SEQ ID NO: 7884

SEQ ID NO: 7886 - DNA, 1329 bp, Homo sapiens
atagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgc

SEQ ID NO: 7887 - DNA, 1112 bp, Homo sapiens
gcctgaatccccttttcaggctaagtagcacgttctagcaatctccaaggtctatcacatcctagacaggcctctgaaagttcaactggccaatggctcttttccagatcctcccccagttaagcccaggtgtctagatgagacccaacagggcagagtgtggccagcccctgccttcatctttcccagcacccccactccctggctcctccccctgcttctttggctgtgagacaggcaggaggtgagagtggcagccaggactgaggcaggctgcggctccttggagtcccccgctctgcctgactctgacccggggctccgcaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccggtgagaatcccagggctcagggcctccacgggttgtgtggctgggctgtgatggggctgtgggcagcaggtgatgctgtttctgcctccccccagggatgtgtcctccgcggatctagtcatcaagaaccagcaaggcatcaaggcagagatagaggcccgggcagaccgcttctcctcctgcatcgacatggggaaggagctgctggccaggagccactatgcggccgaggaggtgggtgaggcctgggtggccgggccattctcactgtgcagtgctgaacgctgacttcttggtggctttctgcttcctctcattctctctttgcaagaaacctttcattctctcccctcagtgccattcacgggtttctcgcattctggaaatctctccccagaaccgtctgcctcttgacatcagaaatcactggtcctgggccaggcatggtggctcacgcctgtaatcccagcactttgggaggcccaggcgggcagatcacctgaggtcacgagttcgagaccagcctggcctccatgggtt

SEQ ID NO: 7888 - DNA, 1190 bp, Homo sapiens
atgtcccctctgccctgtgtcttcaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcacaggaagattaaataatttgtccaggacttcacaagtagtaagagagagagatgaaacccaggccgttggcagactcgcctcccaaccccgctgctttattttctaaaacccaaggccagcgtcccacctcagttagcaggtaaatgcaagcaggtaccaccttgtgggcagtgggtaagaccctcgggaatggtgatccgggagtcttgtgtgtgctctggatgtgagaatgttggtgggaggtgagggg

SEQ ID NO: 7889 - DNA, 1139 bp, Homo sapiens
tacaggcgtgagccaccgcacccggcctggaatgctgttatttagattaactttcttcctttatctgagacaagggtttttgatccattcattcaaatgtgtttttgagattgctttaccaagctaattttaaatacagctctccctgtgaaaaaattatattttgtatcctggcttgaaatttctatgaagacagtttgtgcccactctgataaacagtgatagacaaatgaaatatttagtagaccctctttggtcctgtttttattgtgaatttatatctctaggctcaaagaattagcaagggtaaaattcatagaggacccagtggctcattgaaacttcattatattctgtggattctgagaatatcagctatcttgagagaaagaaaagatccataaggcaaggaaaatagcaactgagtttgaaagtagcactttgcacatgtagggaaatctatgaccacttgtaggtaggcatgaaaaagtgcatgatttcatcagtatgttcctttctttcctagcgtggtaccatgcgacgacgctatgaagatgatggcatttcagatgatgaaattgaaggaaaaagaacttttgacttggaagagaaactgcacaccaacaaatataatgccaattttgttacttttatggaaggaaaaggtcagtattgttttggttccagcttacagtcctttgatgtgggaagccatagactctgagcattgggggtttagcctttatccagctaaaatattgcctgttgatgttatctatctattttctcttgttatacaatgccatttgcatgcacttatcccccagtcctcccaccctgtgagtcattctctcctatattagaagtaatctttttattagggcaggagtattgttggatttttttgcctaacggcctcttcctccttcttctatcccttggtttaaatttaattaaaaatagtacaatagaaatccttttatgtatatatctaccccaccaaaactgagggtgggattccatgcgcaccgtgcatctttgatccttggcaaactgacaaggatgtcatatatgtattgtagtggtcaaaattaatgttttgtttacttttttttttggagacggagtcttgctgtgtc

SEQ ID NO: 7890 - DNA, 1197 bp, Homo sapiens
agtagctgggattacaggcacgtgccaccacacccggctaattttttttttttttatacttttagtagagacggggtttcgccatgttggccaggctggtctcgaactcctgacctgaggtgatctgcccaccttggcctcccaaagtgctgggattacaggtatgagccaccacacctggcccttttttttttttttttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctctccatattttctaagagatgcttcttactaagcatatattttattgactaacagcataactatatacacagaataacaaacaccatttatactgtattacttaggatcctttttatggtccttttatcgtttttaattataccacttatctttctaatattttcctatggtgacagattttaatgtagagtatattcagcggggtggcttgagagatcctctgattttcaagaattctgatggactcggaataaagtaagtgttttcagcctggctggatgtagttgcaaaatggcctcgttacacccagggcaataaacagtggtggtattgataacccaaaacaatagtaattgaaaataatttcccactttgttttaaaagtatatgcttttcttttgatacacaagtgtttcatattagaggtaaatgagaaaatatagatgaaccaaaaaaaaaaaaacaacaaatttaaatctcctgaaatctaccacccttaggtagatcattaacattttattatgtattcttttttcctgtgcatatgtgtaaatatataatcacctatatttttaaaataatttcaaacctgattgtgaatattactgtgtctggggagtactcagtactttaagaaaaaaaactcacatttactagagcaattgtgttttccatatatacttactggtgtttgtttcatagaatgccggatccagacttcactgtgaatgatgtcaaaatgtgtgtgggtaagtgtcgagcttttggcctctgtctttaaggcaaagatttaagacttaggactgaattaaatctctgactgagatttaag

SEQ ID NO: 7891 - DNA, 1119 bp, Homo sapiens
cattcaaattatgagatagattaggtcaacctgcatcaaatcagtatagatcagtaagtaagagcttgactctagagtgagcctgccccggttcttttcctgctttgttctgtaagttacctaacatctgctttctcatgtatgaagtggagattagtatttagcatttagaattgttaggattaaatgagacattagataaaagagtcaacaactgactgtatagtaaacatgccttagggaataattattattaacattatccattgtctttcccattctttgtgatttgattatgattgttgagtgagaactttttccttgtgtattattgaaaataagaaaggacagtattttttcttctactttttaaaaaatattcttactatatttaaggatattagtggctcgatagagatgatcgatgcatcttttatggcagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggttagtgtaatcattttcttcatattgtcattgtcaccaaaagggttgttttcggctggacgttggtaactgatgcttgttatcccagcactttgggaggccaagggaggcagatcgcttgagctgaggagtttgagagcagccggggcaacatggtgaaaccacatctctacaaaaagtacaaaaaaaaaaattagctgggtgtgatggcacatgtctgtagttccagctactcaagaggctgaggtgggaggatcacctgagcccaggaggttgaggctgcagtgaccggtgattgcaccactgcattccagcctgggtgacagaacaagaccctgtctcaaaaatttaaaataaaatgcgttgtttttatactgggaaattttataactttttgcacatatcaagattaagctgaaggtaaacaagactatttgacaagaataatttgtatttttataaagatatattgatattgtattttgataagaataactg

SEQ ID NO: 7892 - DNA, 1182 bp, Homo sapiens
tttaaaattatctttgaccccaacctttcccttggagcccaagtgtttcctccttctatttaaaggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtatggtcatagttgtgataggggttggaatctgaagttggttgtatgactttgcttcagttcatgtatacttaatataccctggaaatgaatctgttagggaattgtccccattcgtatctggaaagaattatagattaagttcaccttcttggctagtgttcagtagaaattagtattcatctagttcactgtcattacaccattggcacagcacttagtaaatctcaatagtcctgtttctagattcctgaatcagagttctccaaatgaagccaaagaagtgattttagaaggacaagataatttctgtacttggaagtataataaatagtggaagggaacacgaattttggatagattcactgtgaaatcagcaaattaagatctaaaccaactttccctctatgtagccattggtctgaaatatggccaaaggaagcctttaagtcctttttgaggatgtaaacaggttttgaaggattatctttattcattcagttatat

SEQ ID NO: 7893 - DNA, 1236 bp, Homo sapiens
ttcaaagactaggtcctacccaaactttaaaaaatccaattgactattacctaggtgtcctcctaggtcaggatcctgtttctacctgttaactgtgattttgaacagtggacaaatgggttggaataaagatagaccatttttttaaatgtggtaattttgtcatttatagcctcaaggcccctatcatgccacctatttctcttgctgatcacatggcagagtgaaatgttcttactgcattttttcttcatattggtagatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaaggtaagggtttgatgtgttacatgacagctactgatccagctatggcagtcagcttccagattcagagggagaaaatataggaattttgggtgatctctggttcagtcagagagaagttaatatgcatgtgtgtttgttattgctgctcagtgttttcattactagaatgaggttatgtccctgttttgaaaatactaacatttatgtgttcattgaagacttataaatttagtcttaaacataggtttcaggctgaccccaaaaataaagtgacccaaagaaaatatttatataagaaatgttacattaaacttaagttaccttgagataaaactcaggacaaaagtgactgataggagtctcatcctaagcagattgagagaaatgaaattgttctatgctgggttaacgttgagtagctttagcctctttagattcaaatttatctagcatcaagacttaaatacattgggaaaagcatcattttaaaataattcatcccattgctttatcaagttttatgtttatttattttttaattatactttaagttctagggtacatgtgcacaacgtgcag

SEQ ID NO: 7894 - DNA, 1258 bp, Homo sapiens
agacccagaggcccaagccctgctctgcctggagaaaggggaggaggttggggcggctttgtggaacccacaagctgcctggtgtgggcatccccattccctgctgggctctagatgacctgcaggaatcctgtcctccagatcaagaagtacgagaagctggagacggaggaggagcgtgtggcccgcagccgggagatcttcgactcatacatcatgaaggagctgctggcctgctcgcatgtgagtgtcctcagctggccctgtgtgctggcccagagtcacctgcagattgggaggggaagagaggaccctgctgagaattcatggccacctctgtcttccccagcccttctcgaagagtgccactgagcatgtccaaggccacctggggaagaagcaggtgcctccggatctcttccaggtgtgtgcctcccggtccctccccaggcaaggtcaccttggacagcccctggtcaacaagcctggtcagccaggggtggggcctgggcaaccacggtctctcggggctcagtcaccaacttccagcttcctcccttagccatacatcgaagagatttgtcaaaacctccgaggggacgtgttccagaaattcattgagaggtgagagcagggaagtgtgggagaggaagggggagggaggggccgctctcagaaggggtatggctggcgtggagggcagaagccagccttcattaggccctgagcaggcaggtggctggcccgtcagcggcccccttgcaaggactcctgagaagtcagacaggctgcaggtcatctcccaccctgccctcctcagcaccaggcagctcaaagcccatcccaggcagtctcctagctccagggagctaggagagctgtgccacctgtgcctctttctctcccgtgggctgtatagcaccttgctggcccacctggactgagaagcatcagagtcctggtaggggtaggcccagtagagcgcatggcccccgtgaccctcacagccagagttggcgcggtgggtgggaattgtaggtagatttcagccagctttagggagcagctgttttagggtcactgctgcccagccatggagtgagctctgtgtcactgggggtatgcaagcagggacaggagacgtacttgtcaaggatatggtagcaggaagtctgggttagactggaagacctcctttctgtgcggatctgattccagcaggaagccacggccaggtggccgagggccatgctgggca

SEQ ID NO: 7895 - DNA, 1197 bp, Homo sapiens
taagcccgggactcagggtggggctgagcccagatgactggcctctccccacagggctcaggaggtgaaagagagcccctttttccgctccctggactggcagatggtcttcttgcagaaggtaacagtctgcggcagggactgggggtgctctgcagccccacccccgagctaatgcccatgacccctgttctgctgcagtaccctcccccgctgatccccccacgaggggaggtgaacgcggccgacgccttcgacattggctccttcgatgaggaggacacaaaaggaatcaaggtactgggccttgcctggcctcttgtacctaggctgtgatcctggcctggggaaggatccctctcccttcttatcacctgtgagaccctgtgccagccctgccagcttgtaggcctcagttcctccttggccaacttccctggggggtggcagttgcactgaccatccctacccagggccctgggtctgggcagcctgtggctgatggtattccggcatctctgtccacccatgtgcccctgccccatccacctggtaaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaaggtgagggtcgccggctgctgcggcaccaggcccctgcctgcttagaagtgagcagctggctcgggtttaaggaactcaccctggatcacagccagaaagtggcggctctgggattcaaactcaggctggggccgggcatggtggctcacgcctgtaatcccagcactttgggaggccaaggagcgcagatcacttgaggtcaggagtttgagaccagcctggccaacatggtgaaaccctgtctctaccaaaaaataccaaaaaaattagccgggcatggtggcacgcgcctgtactcccagctacccgggaggctgaggcgggaggatcgtttgaacctgggaggtggaggttgcagtgagccaagattgtgccacagccctccagcctgggcaacagagtggagaccctgtctcaaaacaaaaaagaaacccaggtggggccggctgagtctcctctgtctctcgcctcagact

SEQ ID NO: 7896 - DNA, 1183 bp, Homo sapiens
cgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctcca

SEQ ID NO: 7897 - DNA, 1198 bp, Homo sapiens
agggaggggatggctggggaggaggagcactggccgcatccctcagcacccggcagctctccttaggtctcatctgggaagtcactccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaaagctgaggggaaggggatgacttctgcctgtctaggcgcccaggagaccagtggcgggaccaggagggtggtgggaaaggtggggttcattggccaaggcttcctggagggaggatgtccttgtttgaggaagtgaccttcccccggccccccaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactgctcccatcctcgcccaggtggtagaagacggctacgagttctttgccaagcggcagctggtgacacttttctcagctcccaactactgtggcgagtttgacaatgctggcgccatgatgagtgtggacgagaccctcatgtgctctttccaggtgagtgtggggaagaaaggagccgctaggccctgtggctcagccccatgagcctgaccaacactgtctcttttagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccag

SEQ ID NO: 7898 - DNA, 1232 bp, Homo sapiens
tggctccattgaccaaaccttgaaagccctgagggtatccataggtgggagccacacccaaaagcattctctcccatgtcacctgacccctactccagctagccctgggacccggggacacatgagcagtacttgcccaggccctcaccctctctcctggtcccgcagtttctgaaacggaatcccagccagcggattgggggtggcccaggggatgctgctgatgtgcaggtgggtttgggaccaccaccaggggtagggctgagtctccaagggtgccgggaatgggggcagggccccagggcagagggagtgaccggggggcaagcagggtgagctgttagtgggtttggtgcattctctacctacagagacatccctttttccggcacatgaattgggacgaccttctggcctggcgtgtggacccccctttcaggccctgtctggtgagcagcagggctggtggccagtggccggtggcgggtggcaagtggagaacctgcatcttggtgccctctgacccctccccactctggtcggcccacagcagtcagaggaggacgtgagccagtttgatacccgcttcacacggcagacgccggtggacagtcctgatgacacagccctcagcgagagtgccaaccaggccttcctggtgagtgcgggggcctgaggcctgtgggaccagggcacggatcgtgactaaggatggcaggcactgagtgtcgcatggccctgcctccgccccccagggcttcacatacgtggcgccgtctgtcctggacagcatcaaggagggcttctccttccagcccaagctgcgctcacccaggcgcctcaacagtagcccccgggcccccgtcaggtactgagggacgtgggggtgtgtggctgggttagggacgctggcaggcaggatgccagctccagccttgggtgccttggccacgtctgtcggccagtgttggcttcggttgctgtgtctatcatggggacctcagttcctacaccccttgtggccaggctgcctggatgggagtttgtggagcccgcggcctgtgtgcctgggcaggtgggaaaggctgccttccctgactgagtgctgggagcctctggcagggcctaggaggctcttattctgccttggtttcccctgcagccccctcaagttctccccttttgaggggtttcggcccagccccagcctgccggagcccacggagctacct

SEQ ID NO: 7899 - DNA, 1273 bp, Homo sapiens
ggaaggccgaggagagctcccggactttcaagatgggaccaaggttcgtgtctaccctacccttctccccctctgcggcgtggtgcgcatgcgaggcgggaggaggccttaggcgagaggttgcgcatgcccagagggcagcgtccactgcccctaccgctcacatgcagaactcgacgctgattgggctgaatttaagtagggggtgaattcgggcctgtctgccccgccccctggctcggccttgtagcagcattggtgggggaggccgtcagtcatcacaagcgggttggggttgggggttgatctcagtgcttgggcagaccccacgctggaggaaacccagggccgggagtggtcctcgggtatctgggtttcaaggctcatgatcctttgtagatggaagggccttctgaaaacacttagaccaactgccgctgtttagagtggaaaaccaagaccctgggacgtgcaaagccggagaacgggcccagaggtcaggtctcccagacagggactctttagcagccttcctgctgcactaggggcttgttgggacagatgagggttgggaagtaaagaacctcccacttttctcctttttgccaggcccccagatccagcccctctgcccgcttctcccccaacctacaactccaggcttccctgcttctcctgtagttgcctcctcccggagtgcttttcccagctgccacttgtttgcagagtagggaacctcccaggggcagcccctgtgcccagcagagcagtcaggcaggacatgcacattgagcaaatgagcacatgccccctggccagcaccgtgccgaatcgggcagctaagcatcctagcccagtgcagtataagtgccctgagagcagaggggagctgcatggctggagtgatccgctgtatgaaaagatatcttctctaagaagagacaggatgtgtggtgtgggttcatgcccccatgtgctggggggttggtggcgttggaagaaggggctggcaagggggatcctggatggaacagacatcagaaggagagatgtgaacaatggcaccccaagatcagaaacaggtggtgttaaataaccaatcgccagcactgattgagtgctcactattcgaacattgtgctacatgcttcacacgtttatttcctacaatgtgagataggtactgttgttgattccgttttaccgatgtggaaactgacttcagagatgcagcatggtgcggcagttaagagcgtgggctcctctaaccata

SEQ ID NO: 7900 - DNA, 1174 bp, Homo sapiens
gctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtcccctccgcaccagtgctgctctgtggctccaccttcacagtgcctgttctgaggctaagggcatggggtgaacaaggcaatgggcatctctggagtttggggtccagcagggataagaatgataaggggatattagagcaggggctctgccatgggtgcaggaccctgggacacacctccctgccaggaaacttgccccaccccctagcagccaccagttctcttcccatttccctgaaggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggtaaggcctggggccagccaggtggtgggggggtgcgcagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtaagggttcacacaccagccctggtccctgccctcctggttgctgtctccctccctgggcctcccagaaaaccctcttgccagcactcaggtctcagttcctgcag

SEQ ID NO: 7901 - DNA, 1228 bp, Homo sapiens
ttattgtcttccccttctggccaagatttgccagaggcaagatcaatggccaccaaaacttttattttattccctggcattgccagggcagcaaggctgcctgccccaggtccatcctgtcccttggtgggactacatatggccaagagacatagagtcaaagatttatagccaatttaaatgttctaggaaagatggatgtgaacaggcattcattaactttttttgttttggtttggttttttgagacgaggtctcactctgccacccaggctggagtgcagtggcatgatctcggctcactgcaacttctgcctcccgggctcaagaaatcctcccacttcagcctcccaagtacctgggaccataggtgtgcaccaccgtgcctggaaaatttttgtgtacaaacaaaaagccactttctggtctcggccgcagaagcgagatgacgaagggagcatcatcgtttggaaagcatcgcaataagacacacacgttgtgccgctgctgtggctctgaggcctaccaccttcagaagtcgacctgtggcaaatgtggctactctgccaagcgcaagagaaagtataactggagtgccaaggctaaaagatgaaaaaccaccagaactggtcgaatgaggcacctaaaaattgtataacacagattcaggcatggattccgtgaaggaacaacacctaaacccaagagggcagctgttgcagcatccagttcatcttaagaatgtcaacaattagtcatgcaataaatgttctggttttaaaaaataaaaaaataaaataaaataaaataaaagccaaaggtgaggttataaaattgactttatgtaaggagaccccttgaaactattgctacagaataaaagatgaaatgctcctgattattgtaaacacaaagttgcatgcaggattgtgtaaagacaatgccaggttggactgccagaatgagccaacagcgcgtgatgtgcttcccccggcagagagcctatgaatggatatgcagtcagggaggtttcacatcaccaagattcctatcccagaaaagcagatgttcatagctctgggaatggaatgcgacccttgtagagagcctataaatggacacatgaggggcccctgtccatatggataagatagggctaaaaatgccctcatcttgccatggctcttctaggcctctttagggttaaggcacactcccttctgagaat

SEQ ID NO: 7902 - DNA, 1230 bp, Homo sapiens
tagaccagtggctgccctctctgggcctcactcccagctgagacctacaggctcagcccctgcccagccctgcctggcacccgctcaatctggctgagctccagagaatggcagggctgggctgtcacatgctgagccacgtgactggcagtggctgggggctccatcccacacagaggacaggggctctgcagtccttcacccccaccctaactatctaatcacgggccaccggtgtgggcatggtccagaagacctcaccgccctcccaggtaggcagggagctggcgggtggggggggccatgatgagcacctcccaggtgccacgttggcccagaggccccggggccgggagctacggaggcccagggcaccagggagatggtagcagcggcaggcccaggaaggggcatagaggaggctcttcctccacacctgtcaccctgtcccctgcctgtccacacccacagcagcttgcacatcatccccacagcacgctggctctgacaggtgtatccggggcgggctgggggcaggcagggacaggcttaggcacagctgcctgtgccgaacttgaggaagatcgggactacaggaaccaccaaggcgacacgtggcatcatgaccacggtcctaagcagagaggcaggcactcctcctgggaggcagaggggacatccgaaacgggtgcagccccagctctggagcaagaagctctgccacacacacgccccatgttcacatcccaccccctctctgcccccacttcctcgtttgtaaaatgttagatctgcagaaagacaggctctatgaatggggcggcccatggggtggtgtggaggaacacggaagcacagggcgctgggagaggagcaggcatgaggtatggtccctaagatggtatttctagactccagccacctttgggtctgacctctttgttttgcagaaggggaaactgagtcttgggtagggtgtagcaagacaagccacagacaaaacacctcagacactggattaaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgcgtcagctaacagaacagaaagttttgcagtgctttctc

SEQ ID NO: 7903 - DNA, 1158 bp, Homo sapiens
ttaattttataatatagatacttaatttcctttgtgagttctagtcttcggtttccagtggtgattaaggcctcagcagctcatcacatctgttaacctgtagccaagtaccctcagcagttaagcttattataagaaagtgtgttctatttgtttaacctgtgctattttctctttcagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctg

SEQ ID NO: 7904 - DNA, 1126 bp, Homo sapiens
ctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttc

SEQ ID NO: 7905 - DNA, 2709 bp, Homo sapiens
atgcctgtctgttgctccttaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaatctcttgtaccttgcttggatttttaatgggttgatgtgtcctgccattaggtcccgtgttacactaggtcctgtgtgagaaagactgcactgcactgtgtgagagagtggcctctgggatcaggggctcatcctccccactgccatagcccaggtgcccagaagaggtggtgcctgacaccggctctcagtcttgggacggctccaagggttcctctggacctccagcttgttacttttatgtgcagcgtgtcccacctatgttgtttggctcccagcccaacaagtcacagttaggtgctccataatgattcttaagatgtgatgcttatgtagctccttattttgcattttcccttcacctgtttgcttaaaaacatgttctctagtcattacctcctagcaggtcctctgcaca

SEQ ID NO: 7906 - DNA, 1178 bp, Homo sapiens
taagttaagctttaagacgttggtcagatcttagagaactggcagaaaggaatttcaatgaaacattgggtcagattgcaaatgaaaaagcttgaaatgtggggatggccacgttttaataggtttttggtttttgtttttacatgaaaggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataatt

SEQ ID NO: 7907 - DNA, 1342 bp, Homo sapiens
ctgccccctgcatagccacatcgtgactctcaggatggtggccagtgactctgggtttacacctcctggaggtcgttggtgtgtttggggcttctgaggaattccatgggggtgggggagccccgggaaggctgagtgaacgagatagttcagctctgagcttgaagagctcagactggccccagctgatggtcctgggttttaatcccagcaccgcctcctgctggcttagctacctcggcagcttgttgcacgtttctaggcctcagttgggttgtttctgagatggaaatagtaacgcgctctgcatcatggtgtgtgtgggccggctgcccgagagctgtcctggccacgcagcagtggtgtttgtatcgagtgctcttgctttgctcatcgtggttcacagggtgggtctctgtcctccgcaggtggtccaagatctattttgtattgtggtggctggtgtcgtctgtcatctgggtcaacctgtttctggccctgattctggaggtatcagagatccccacccaggctgttctccatggtcgtttgtttctaattcactctcgatgggcctgaggccaccggccgggcctgcctggaactttgatgggagagtcgtgctgggttaggcgggtcctgagtgaggctgagcccctcccgtggggctcagtgctgcccgccctggctgctggggccttggggagtgctcctgacatctgggctgctggggccttggggggtgctcctgacatctgggctgctggggccttggggggtgctcctgacatctgggctgtggggattctcaggcccccaggtcgggctgaaggagggacttggacattggctccaggaggagccagcagcctcgtggggcctgtgcctgggtgtccagggtgaatggctcagccccctcagcgggtgccctgtggctgaccctggaggggccggggatggggcaaggctgctttcattcggggcccacactcactggccactcctcctgcttgccagaacttccttcacaagtgggacccccgcagccacctgcagccccttgctgggaccccagaggccacctaccagatgactgtggagctcctgttcaggtgtgtgggtggggaaggcgcttctgtctggccccctgggatgggaagccaagagctggggggtggaggggttgaggcggcgggcaggccctgatgactgtcctccccctccgcccggttatctggctttggtcctgtgctctaggagagcagctcagagccgggatcggggcggcttcttcttcctgccactggcgtcatagcctttgtcctgctctcctgctcttgga

SEQ ID NO: 7908 - DNA, 1197 bp, Homo sapiens
ccccggcctgggtaaagggtcgcccgagggtcattttcagggtttttttatgcacttagttatttttttaatatttttaaatattttttgaaaagatgacgtctggggaaatgcggcgcggcggcctgggacgccacctttgtgtctcgcaggcgcggcgcccaaccccgcggcccgttccgcggccccgcaccccagttggtgtcgacccccagtcagagggaccacggagctccagggcgggccagggtcccgggggccggcagcccgcgccgccgcgcacgccgcccagctgtgcccgctcccgcccccaccgtgccagcctcgcggggactttccctttcagtttcggggagggtgggtactggggacgcgcgggggagggggcgcatcacgggaagctcctgccgcccccagccccgacccctcggcgccctccagacctggcggccctgccaagcgcgatggggggtgcgggggcgtgcgggggggcggcgcgacctggcggcggcggtcacgggccccgtgcctccgtaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctggtaaccactggaccccgccgccccccgccccccgcgagccgcacgcaggaccacggggccggggaaggtgcaggcggtggcggccggcccgcctctgacatatctgctcctccgagggagggcggccccgccgccgggcgtccctgtccggggagcgggcgggatcctagccgccctcgtcccgccgccctgtgtgcgcttgcctgcgactcccaccgcgttcgcgccccgcggtgtggccgaaaagtgggcggcgcgcgccctccagcggctgcacgaggagcgccgcgctcggcgctgagcctccagttccaggtggtgggaggtctttttgtttccacttgcagagtcttttcacgcggcgggcgccttttctgttttgatctgggattgcgtgttgccccagctcccttgagtccccagcattcgccagccctcccctcc

SEQ ID NO: 7909 - DNA, 1753 bp, Homo sapiens
gtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccagcgtggtgcctgcctctttgcttcctgggctggccgtgagccagggacgcgtgtcctggtgccctagaaccagggcagggtggcaggcttggcggatgtgggaggccgcagcctgtcctgtgcgctgtgggaagttcagcagcatcctgacctccatccccgggatgacagtcacgccacccgccgtgacaaccaagaatgtctcctgacactgccacatccccgggggtggggacagaatccagccaggagcaggcacacccctcccaactgggaggaagccctcagcacaggtgtgtgaggtgggaggcggtgtcctgtccccgggaggctccagagaataatttgcaggctgcctggctgggtgagcccacctccaaccacgcgagacaacagctccggcctgggtgacgtgagcggtgcccattgatggggaacatcttcccc

SEQ ID NO: 7910 - DNA, 2765 bp, Homo sapiens
ggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgtcaaaagttgtcacgagtgtgctgctattctgtgttttaaaaaaaggtgacattggattccgatgtcatcccctgtagtatggcgtggagcatctctgtctggaaaggcccgcctgaggcttgggcagccagttcagggagctcccaggcttggctctcggctagcatcctcagaggcccactccctttgtgccctgttgctattaatcgggacatatcggtttacttcgggtacagaaagtgcggtgttgaagtcctcgctgccactctgtttttagatctgccaagactgacctttgaactttcctgtagtcaatcttcctcgatctaccagatgggagagacccttggacaactttataaactcctgtttgccttttttggatcagcgacagcccccatcgctgtgactattggggaaaagacgaagctctttcataaattccatggagaggaatcaatatcccactggaaggctagaaatggacaagatagtgtatttgcaatcacaaacaaaaccctagtgatgaaaaataatttgtgatggcagatgcttctgatggtgtgatagaatatgtttttgaaaacaaaccatcgaaccccccgccccacccccaaaacgggcttccctgtgtttagggagctttgggctagaactagctacgatttttaggtgaaatgtccttgtaattgtacaaagcacttggtgcagtgtttgcgtggagcagcctgctgctttctgatgcattccctgtttaagtgcgtttaacatctacctcacaagccctgaaaccccaggcaaaacccacagaaagctcatacccggtgcaggagtttgccatcccaagtggctttttttccatatgtagccaaaaaggattgcagatagcgtcggtgcgtcccattcgaaccttgtcacgtttgagctatctttaccctgtgatttacttttagtaagggtgatcatggtgaaaatatttgcagacagctgttacagtacactatatggtcaccaagtaaccttatatttttctttatatattttacaaatgtaacccctgtcattgaagcaaccgtggaagaggcagggtcggtgatgtttaaaaaaagttccgaggtgatggcaaacatttaattttaatgaatgactttttagagtttatacaaaatgaccttagcttgctaccagaaatgctccgaatgtttcgtcaagactttaatactctcctaggatgtttctgaactgtctcccgaattaactttatgggagtctacagacagcaagactggaaaatctgattggagtttttgtctttcacattccttttgaaaactctttgttcgaatgcaaatcatcgacttaaaatactattcttaaccaaggcctggaagaaagaagacacttgcaaagccgctaagacaggaccacacatcttaaactgctgttcctaccatgcactaaactgtttttaagttttaaaccacaccctaggctccaggagtgttcaggaaagatggtgtttgtaggtctccatgctgtttggcgttggggggtgtggagggatcatccgtcgactttctgaattttaatgtattcacttagtaacaaaccatgattgtcttaaatgccttaaattattatgagatttcttgtctcagagcccaatcagattgtcaggaattaacatgtgttaggtttgatcacccttgaccacttcttatagatatttcttcaacaaatcatgtgtgatgcctgtaggaacacaactgtacctttaaaatattgttttcatattgctgtgatggggattcgaggttcctgtatgtgccactgttttcagaatctgtagttttatacaggtgccgaccctcgttgtgatgtatgtgctgtgcacattgacatgctgaccgacaatgataagcgtttatcgtgtataaaaagacaccactggactggatgtacacaactgggaaaggaattaaaagctattaaaattgtgccttgaaatgccaagacctggttccctccccctgtcttccaggggtctttctatttgaggcctgagcctcacatggctgggggttggggtgggggcaggagagacgaattttagccagctgtgtccacacaaatgtagccttgaaaacaggagcctggggggtgtgagtgtcacaaagttttgccatgacagagtcttgcagtttattctcattctcctgatggggctaattcacgccattcccgcactgtaactggccctaaactctgtgcccctcccattggcctcctgttctctaaagcaatttgcacttccctagggggagccgtgaagctccagagctggtcattaggaggcagactcgagaatatttttcaaaatctgagtagacaccatccatgggtattgaactcaatataatgaactgcagctagtcttttatttttaattaactaatt

SEQ ID NO: 7911 - DNA, 1128 bp, Homo sapiens
tgggtggcgctgcccaagcaggctgcaggcccaaggaggaacaaagatcctctcaaggggtgcggagctgaggttccggtcctgccaaagccacttgatgacccccaagtgcccccctttctgcacctcagagaagagccctcaagcctcccaggtcccctccaggggcacgaataagccccagcagggttctgaaggggtcccaggaatctccctgtggggatgcggtggaggtggaggaggctgcggtggcctggggacatctctggtcacaggtgctggtggtatgagagatggggtaggcaccaagccccctgcagctgtggctaggcgggcctgcaggaagggccaggcaggctcctcagggaccacaaagaacaggggttttcacacctaggtgggcctgcatctagctaggacagtccccatcaggccataatgggcacagtgggaggtagaaccatgagtgagagaggggaggcttccagaggcctggcctgggtccctgctagattgagggctctggctatggtacatggatatttctgctgtggaatcaaaggagcaggggatgctgaatatcccctctggccctatgccctgctacctgtcctttcacggaagggtgtgtgtgtagggggtgcaggaccaggcctccctgggtgcatctctgccaccttgccctttggctcaggtggacctccaccaggtattcagaactccagcccagaaacgcgccaagcctgtggggccaagacctagggggtgggggtggcctccctcccgcctgtagccaaagggtcctcccttgcccagccaggccccggtgtcgcttactgctcttatccacccctccttcccaggccggtcctcaaggccccagcaaaggaaccaagttcccgtgagcctccgaaaggcgaagggcaggcagcagccgctggcttctgcgcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagg

SEQ ID NO: 7912 - DNA, 1295 bp, Homo sapiens
tcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaagaatactgagaataagctctaactgttttggaaggcagtgtcaccatatggaaattgtattacagaagtcaattgacagaataaagcagccaggagatgaagtgcaggttcagggcgtcatcctgcccgctgctctggaggtcccgagcctgcatcactgcaggagacaggtgcctggtgttaaattgttaaatgcaaatgtgggggctcacatacacagtcggtgggtagggcccaaaggcagagcctaggccgtggaccgcgcgcatgcacgcatgtcccttaacaccgtttcccagctctgcttccttcctcggtgctggcttcacactcccacctgctctccctgcctgctcacaaaggtggctcccaggcctgcacccttcca

SEQ ID NO: 7913 - DNA, 1768 bp, Homo sapiens
tgttaaattctgaaacgctttcctctcatctttgaatgtataaaaaagctggagtacttcaagtacagacgaatcatctgaatgttcagcaccactggacttctgccagtggccgaggaagggaccatagcctcgtgtttccccctctacctctggatgattacagactagctttcctattttctgcgtgtgaaataaaggtcaggcttcagtagagccatctttagcggggatttgggatgatcccagtgtctgccttcagattcgtgttctgtctcccacagagcatgcgtctgatactgcagactgccgaagtgggtgtaccagccggcagaatagtcaggaaggcacagtgcagggagagaatcggtgaacatcagataagcagatttacaaatttacaaagataatgtcacctgttcttatttatcataccaggaggcaaagctgcacgtctgttttattgatctgttcctattttcatctcttccatcaagcatacacaagctgagggagaatgtctttcaagagcatcagacccttaaggagaaggaacttgaaacaggaccaaaagcttcccatggctatggagggaaatttggtgtggaacaagaccgaatggataaggtaagtggcccgcggctgcctatgccaggctcctggtgtgcttggaccactagactgggtggcagagtcgtccctcagtctttccttagatcagcagttttgagtccatctgctgaggttgcgatttgcccggagtagacccctgttgattggacttactcatgaagtactctagctttcttcaaagctctttaggaatcctcagaggtgctggagcacgggtgttagtggggaggcccagagagggagattggccctcagaggcagccttgtgataggacagaagtccagaagcatcctggctctaggtgtcatcactgtcaatgcctgtggttccagtctgtagcctaagtcatgccagtccgaagaccaaagtcaaatctgtaggtccccatggttcacagcacacacggaatccagccaaaggcctggctaacatccttcatgcgttcagtgaccatcagagcagtctccctcgtgtaaattcggcgcgtaccaggctggggacagtgctcactctattcgagaggtctgggcaagcctcccagcagctgtcattgatgggatgcagactgccacgcagacgttgattgaggacgttggccaaatgcatccggctgcacccgtgctttaggtcctctctaccttaagaaagggagccacgttagctcaggagggctaccttttccttcctggagagaagatggaagagatcgcagtgtgtttgcatgtttcttcagtaaaacagacatcctggaggtgaacttttgagtctgagcaacataagcttgttctgacctgacagatgcttgcctttactctgtggaaagaagtgtgttagccagtgtcggattccagccggtaattccatacccctctcccacctcatgcaccagccagatgaacatttgagctgggcacgggatgatgttgccgtgtcacagtgagctgcaccttgctctgtcccccgcagagtagatgatgtggtgggccggcagggcaccccaaaccacgaccataaatagcctgggggaggagtggggtgagggaccttctgcaggaaagagacatggatgttgctgcgtcactaccacagagatgccctgacaccgagaagagcaatgtgtgcagaatcatcatc

SEQ ID NO: 7914 - DNA, 1374 bp, Homo sapiens
cgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtgatttgctttggtctgtggtcactccgttctgcagtggaagctgcgtcgacactctcggtgtcctgcgccccggacctgggctggcggaggctctcctgccgtccagtgcgtctcacgcgttctgttctggctttagaccgaaccgtacgttcccttttcagtgttcattcaaaggtgctgcttatgaactgaaatgtgtttactctggcagatgattcagttttttgcacaaaggttccaagcaaaataaaacactctgtgcttaaaagtcatttctgaattacagttctcaaatcctgagggggattttgctc

SEQ ID NO: 7915 - DNA, 1168 bp, Homo sapiens
gcgtttgtcattctctacgttggcgtgatttataatgtcactcacccatgagggcccacgtgccctgcgtcggcttcaaaccgtgtgcttgggccccagaacgtaatctcagtgcaatcaagccagttcttcagctcacctgtgccatgcgtcaagggcatctggagaagggtagagagaaacccaggtaccagcccagggccggtctcccacccttcccgggtgcagagcaggtgcccctgggcttctgcctaaggaagtctctgctgagcagcagctgaatgcaaagcaaagtgaatgagggcgccaggaaccagccgacaagcattccagccgtgggggtcccagcggctcatggccagcttctgcctgcgccgtctcacgttaccctttaggaccctgggccagtgctgggctctcgctaagtaaggtggcttcatcttgtgagatatgctcatccactaaatgtatcttttatttatatttttaagcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggtgcctgtcatggctggagagggtgaaacgccgatgccggcaggctctgggggaacccgcaagccagagcgtattcccatgaccttaatctactgcttgtaaaagagagtcagctgccctccccaggtgtcaccaggaagcagccggcgagcacttggtgaaggaagccatccttgggtgcctgtctctgccagccctgggaggggaggaggcaggttctacgcagccaggcgtggtccaggaaggtctcccttggggattacacctgggtagaatctgggggtgtgtgggagttaacctggtagagtggaggcaagagtgcatgctccaggaaccccctgtagggagagagggtggcaagtctgggacactcagaaacatcccgcatcctgaccagagagcgttcaggagctcagagccaggtgaggctggaggcctcatggaagtcttcctctttatcttaaaagcagca

SEQ ID NO: 7916 - DNA, 1318 bp, Homo sapiens
aagtggggcagacccagggagccccaccacccatgctagatcactcctggcagctcttgcacagagtctcttttctttaacacactgacagctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggcc

SEQ ID NO: 7917 - DNA, 1137 bp, Homo sapiens
agtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagtactgagttgacttgatcggtgtgggaaaaagaggaatataggctctttgaagcctaccttgttcctgctgagtcttccataccacctcctttctctcatcccttttcctgaggccacatctttccaggctcttcccactctccattagtggcctctgctcccggggagcattatgggctgttctctcttttctttttcaagcgcctgtgttcccctgaagcaggtgttgtcttcagcttctgtgtggcagtccctctctcccatactccctcgtgggacaggcaaagttcctgggagtggaactgaagcctaaatgaacagatgtcaggatgcctccattgaataatcctttatgaggacccatgtggggatgacacagatacagtgtggatccgaagcagctgctgcccccatcccttccctggaacagtccattagagtgaagggggaaaaaaaaaacatacagcacgaagataggaagtct

SEQ ID NO: 7918 - DNA, 1189 bp, Homo sapiens
tgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggct

SEQ ID NO: 7919 - DNA, 1150 bp, Homo sapiens
ggtgctgggtgatgtcttgcaggtaggaatgcacagaaagacctgtgtgctgctggttggtgtggactcacattcagtacatttgggttcctggtgttcctccatttccagaggagtcttgatgactgaggagtcatgctgatcccagtttgtctctttataccaccagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggca

SEQ ID NO: 7920 - DNA, 1880 bp, Homo sapiens
atcagccacacctaattggctaggtgggccagagttagggaaggccagggcatccctggccctgggtccagggttctgtgccattttctctggcccagcttgcatccagctattcctgcagggcgtctaactcattgccacttcctctgatcccacccagaatggcatgggctgaggatgggaggctttctgaggccgagaactgggaggcccctggagctctcccatccagcttccttcgtgttaagagagaagattaaatctcagagcaaggtggggattcccttggagtcactcagcaaatcagtgacagagctgggtcgggagctcaggcttcttgctgtcagtccatggttctctctggaaagagggggcctagtgagaccaagcagcctgatagaacttgacacttgaggtcagtgtagaggctgaaagaggtcagaggtgggaagagagactccctagccctgagcccagcgtgtgtcaaggccccaaacaggaaagggaggggattttgaggtccctgcttgggtgggggtgggggtgggcatcagtaagtacccctgggcctggacctcagcctggtccagcataggtgagctgagctattccatccttgatggcagggaagtctggaaggccagtgtggtggaggcggcagcggtagcggccacagctcttagcatactgcaagaagcggggtgcaccagggaagagcacatggtcagccagcacggtggcacctgctggcagtagggcatgggcctccagcagctgcaggtccctcaggtaacatcgtggccggtgtgccaggagcaccaggtctgcccgactcagctgatactgggtgcgtaggcacgggatcacgtcctctgagctgcccacgatgagctccacctgtggggatagggggagctggaggtgagggtggggggaattgttctcccagtcaagaccccaccaggatctggcttacttcatgccaggtcctggcttagcttcccatgagtgttctcacatttcctctgacctcagaacctaagaagtcaggatcagtattgtgatttccattctgaagaagctaaggttcagaggatgcatgctttgctcaaggtcacgtagctaacaagaggcagagtaagagctggacccaaatttgctgggttccagagaccttcctcttagctgtttctttcgtcatccggcagaaaataatgtgcagatgacttgggacaggagggcaggagctcacacaccatccagcatcacagtccccagagtggaggtgcttccttctccttagatgggagtccttcacaagggatgtctgggggcaaggcctggggtgacaaaaatctgggttggggagatgggaggctgaccatgtgctcatcaaagccggccaggcggatgagtttttcagccactgctgccgtgcgtgggtcccgctccacagtaagaaggcgacccccagggggcagggctcgggcaataagcagggtagagtatccacagtaggttcccaattccagcacacaagcaggggccttctcctccaccagccgcatcaggatctgacctatgaggggagatggctgttgcagaagacatgggagatggatgcagggcccctgataaaagatatctcaaatgcctacctgcctcactgcagctcccaaccagccggggtctcatctgtctcttgtaccatagccccagctgccctcctggtccccgtctcctacagtgtagtcttcacaccagccctggaatctttccaacaaatctgaccttattactccttggctcctgtgagctgaaggcctttgggattgaacttgggattctcagcctggcattcaggaccttggacctgatcc

SEQ ID NO: 7921 - DNA, 1298 bp, Homo sapiens
agcgcagtcctgcgagctagctgttattagccccaattggcaaatgagaaagctgaggctcaggctcaaaggaggtctctgagttgccctagcagtaagtgatggaggccgacctccaagctgggtccaggccgagggagtgaccacttcacctccccaccgacaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgt

SEQ ID NO: 7922 - DNA, 1107 bp, Homo sapiens
ctccacaggcccagcatccccagatcatcttctcattggcctctgggaacttcccaggaacacgcacgtaatcttgccactttctgtcagccacagccatgctagcttaaaacccaggcctggcctgtatccccaagcctacaagggacctgccccagagcagccagaatatgctttgttctagggcacagccactgaagggcaggactacttgtggatgtggcagcagttcttgggatgactgatgcttctggagcgagaacttgctgttctcagaagcagagacttagaaaacatccccaagcagaaagcttcttcctttgtccgttggaaaactctgtggcaagacatttgtagctaagaattggagtgttcaccaaggacattatctctgccgtgccttaaaatcaatcaatactcccagctattgtccagtagtttacattctctgcttcccccaacccccagacaagagaattcactttataaggagcccctcttcctagccttctagatcgaacacctttgaaatgaaaagacgagggccttttatgaaactccctctatcctcacccccaggccaaggctggccctttgagccgttccaggggcatggttcctgcctgttgacttggaacagatgcccttagcccccacctttacatttctcccacctgcctttttagccagcatacatttacaccccttgccctagcctcccagcctcaagggccaaaaccattaacccactatttctccctcccaaccctgaacaagttgccgtcactcagggcctgcaggctgccaacttctgacctcccttcccccttgacctcccttggtctgcctgtgtgtgtgaccagccaaccgagaggcaggatcctgctctatcattctaggggctgttgccagtaatatttccagagtcttttgacctcagctgaccctctccaaagggtttcaggaaaggcaagggagcctaccttcctgcccatctggctggcttttttttttttttttaattgagacagattttcgctcttattgcccaggctggagtgcaatggcgcgatctcggcttgccacaacctccgccttcaagcgatt

SEQ ID NO: 7923 - DNA, 1176 bp, Homo sapiens
ctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggtcagggcactgcagctctggggccccttgggaccacccccgtctttctgctgccctgttcctcatgctgtcttaacccatctcatctaccagctcagggagatgtcttggcatatggggaaactgatgtttggagggcagaagggccctgcctaagccatgtgaaaagttctggccatgcagggaggagccaggcctgacccttgggccaagggcacatccccagcatctgtctgtctctctcccaattcctcagtctcctgcaccccgtccggttgcttctgaatcctgccaaaaagagtgaacttgatggggatgctatttcctgtcaggctcatgaaaaacagctgggctgctctgacccatccccatccacaccccactcaagatgaggccccgcatgggccccaggccctgacaggctgggagccaagtcttaggccctgatctggctctgcctgagtgggaggcagccagctccgaggcaggggtatgccatttgtgacctctggttggccttcagcccctcccccaaaccgcccctcccaggcagactcagtccagctagaagcccggtgggagtcaggcctccacctcccagggacccaggcgtcctgctcccagcccaacccagtctagcctgcaagccaggagggcggcaactcccattggttgggagggctgggcaggcggtgaggaattcaaatgtgggaggaattagctacaaagcacaccccccccccggctcctccacaaggcagaaggagcttgagatcctctggaggctctggctgactgggcagctgtgtccaggcagccagcaggggtgaggccccgggcagctgggatcccctggcctctgctaggcagcccctgctcacccctcctccccttggcctctctcttccctctccttctctctttcttccttcctattctctctttcagtctgaggatggactgctccaggcctgggtgactccttccttttctttcctctcctcc

SEQ ID NO: 7924 - DNA, 1293 bp, Homo sapiens
gggtaagaaaggcacttcggaagtgcagggggaacagcgtgtgcaaagctcggaggacaggattgctgtctggtgactcaggaggaggggagagctgtgcaggtactcagcgcagtgcctgggctgctgggcgtgtgccagtgaggcctccaggtttctgtcttgggtggctgggtggacagtcgtgccatcactgatccagagacccaaggacagaagtgactttgggaggaagtcgagttcagcttgggacctggcaactgtgagatactgcagggtatcggggtccatgccggcatcaagaggcaacatgtgtaggaaacggaaagctgcggggtagggttgggggtgaggggactgcccaggtcctggtggtgtgctctttcacaccctgtccccttctcccactgccaaatgtcagcaaatcctgggacacttctcaggcctcatctggcatgccctccctcctcagaactgtttcccctctggggcttctggtaccctgtgttttcttgagtttcctctggctcctgtggatattccatgttaatctccttcacagacgccctcccttcctgccatctgctgggatgcccggctgtcagggagcatccccagacagggtagatatgtgtttggggtgagggagatttggtggagcacttgggcgaagtgaggctaatcttggaaggcttcttggaggaggaaggggtgtgcggagagaggtctcctggtccctgtttgtttattgctgggcactctgctgggctctgtgtttctatggtctccatgatccctgcagcagaccttctgggagatttgtgtactggctttacgagcaggacatgaacaaatcagagggagagcagggagggggccctggctggatccatgccaaggacatactcagggggccttgtggggagggtctgggagattctttccacccagggaggagcattaagtcagggggccttgaagaccaagctagtgctgtggtgttttgagggttgattggtagaagcacaaaaagggtacatgctcttcctgggttcacacaactcgtaacaggtatagggtctctccaggaacctggagggaagctcagattgaaggttcctggtgcccttgcgccctctagtgaccattcttctgcatgcaggagcgttttctatttcaaccccatcagcttgtgggggggagagagagagagaaaaagagagagagagagagagagagaggttagaagagagaagaggatagagaagagaaagtctgtctgtctgtctctgg

SEQ ID NO: 7925 - DNA, 2381 bp, Homo sapiens
ggatgcttcagatactgagtcaggaactgactgacaaactacgtaattgtttcctgctcaggtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaattatgttttctaagttttaatatagaaaggtttgggtaaacagacctttccaaaaggcccatgcttcttataaaaacattcctgggccctcctttaaaccagctaacagacagagagaggagaaagtaaattaatccatctatgagacagacagtccctgaagcccccatgtgctaggtgtaatatcctgggt

SEQ ID NO: 7926 - DNA, 1232 bp, Homo sapiens
cgtgcgttgggaaaatcacgccgcgagggggcgcaagagccgcgtactccagagcaagaagaaaaggctcggggatccaggcggagagtccaggagaagagccgccagactgcaggggcaggtggaaggcgtggcagctggaaaagtaggggtgggggcgcggtcgtgaagggtgggacttctggagcaacgctgggcgggttgggggccggtcggagccggacaggcggctgggaggtgggatgggcggggcgcttgggagcgagatggggggacaagggcgtggctacagctaaattcgccgcagagggcgggcggggagggggagggaaggggaggaggcgtggcctgggcggggagtagggcgcgacggacccttcagttagcccgcggctccccgggctctccctggcgccgagtcccacccctttcccggcccagagagtgtgcgtctgcgtgcacctgagtgtcagtgtgtacgagagtttgtgagtccgaggttgccatgttggagcccctgggcaggaggtgtttccgcgcggaggctggtggcccgcggtggacgcggcgccctggctgcgagtctgcggagctgagcacgctcagcggttgtgtgtgtctcagcgactccctgggggcagctcggcctgctgggctcccgagggacctctctggagggccagagggtcgcctcagtctgcaagtcctccagcaggctttttcttcttcggctcctccctgattccctcccaccacgcggttcccaggctcgcgcacgcccggagcccaccccctcttttgggcgcgaggccccgccccccgcccccttgcctctgccgcaaagtttatttgcaacaaaagggtgccaggagcgagcagccaagggcgttgggcaggcggacgcagagtcgaggaaccaagcgctgggatcccgcccaggcggtgccgcggtgcccctggtcgctccagccgcggcgggggctgggcctgggggtcggcgctgaggcgggaggggccgcccgggatggagacgttgcggccggtggccacagaaacttgagccgcggcagagaaacctctgctccggtctctgcgtcctcttcccacactcccgtgcgctgctttcggcgtgggccgctgcgctcctagggagtgggggcgcagggggggttggccgcggctgcccgaggccagcccccccggagtgagttacgccactatggcggacgggg

SEQ ID NO: 7927 - DNA, 1122 bp, Homo sapiens
tgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggtgagtcctttgtaggggccttcagattggggccaaagaagggccatgggcaccgacttcggttggagccttttgcattgtattcactggtcaggtgcccaggtgccaagggtgcttttctggtcctggaagtgcctgtgcagttttaagagttgttaatgacacagggctcctgtctactcaggccctgtagaagcttcagttttctgctggtgctaatggcaaagggtcttgtctgctccaggtgttctgggtggtaattacaaaggattcttatcttgtcctttggatgtttctcagggactggttttggaaatccctgtgtggttctttgttggagggatgagtgtgatggcacccagcgcaggctcagtcctttctctgaggcttgctactctgttggccagacccttgataggatgtttggctcaggggccacagttgacatgggtttgcccttcttcgtgtggctttcctgtgacaggtcagaatatagatgtgttcctgggcctgggagaattggggaggtacaaggctttactttatggaggagcagagggggctcagggttctaactgcagttctgttcttgctgtgtgacattggcctttctctgtgacttaatctccccaatcaggggagataggtggacaaactagtgcctatgtttccatccagctggtactgtgcagatttgggggagcctgcggttttgagttggggactcttggggcctgagttctgccagagcctcctcagatgaaaaaagcttctagatgggggcttctaggggaggatagaggcagggagggggctgcagaggctgggc

SEQ ID NO: 7928 - DNA, 1213 bp, Homo sapiens
ccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggtgagatgggcacagatgcagcaggggcaggtaaagacgtgacagcctgggggccgggagggggaggcagggccccagcttgggccctgagcaccctgctcaatgggagccctgcccttattgggcctctctgggcagtggaggcggccagagagatcaggactttccggttatgttgtgtctcacatggagcccttgcatccctagggcagcatcttggcccccatggcacccgggcctctcaggctaaggctctggtccatgaacttgctgtgtgaccccgggcacgtgctgccttctctgtgccccgggatccccgctaacggggatgattgccccactctcctcacaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggtgagagtcaaggagaaaggcatctgttggcacctgggccaaccctgaccgaagacggggcaggggtggaagtgcagcgggccctaggcaggggccactttcctggagccagaagccagcccctgactcagctctgacccctcacccctgcccaccaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacggg

SEQ ID NO: 7929 - DNA, 1299 bp, Homo sapiens
cctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattcccccccaaaaaaaagtcttaggtgactagactgagtggttcttggggagggaggcacagaggactgtcctgggccagtgagtcccttgggcgtctccccaagttgatgctaaatttgttctcagtagtcaagaaaaacctatggtaca

SEQ ID NO: 7930 - DNA, 1275 bp, Homo sapiens
cttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaactgtggcttgctttgttcccccagaaggccctgtttccctctccatgatccagcagctactagtgccttcactggtctagtgaaaaagagtgtggattctgagatcagttggaactggtgacagcatattagctgagtcatttggggcaagtcacttaacctttctggattttgttttccctacacttaaggtagctggttgaagttgaccattcctgagggctcaagaggagggactgccttggagtctctgttgtctgagctgatggatgatccaagccaggtcctgcctgctttctgagaatcctgttcatgttggagtcttttccagtaggttcccatccttctagagttgaatcaatgaatt

SEQ ID NO: 7931 - DNA, 1126 bp, Homo sapiens
atttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagat

SEQ ID NO: 7932 - DNA, 1107 bp, Homo sapiens
gcggagacttcgggaatccgctgaggaaattcaagctggtgttcctgggggagcaaagcggtgagtgcgtggctcccctactcctggcagctggccgcagcgtccccgcaccgcccccggtgcggcccttccgtccgcggaggctccctgcccgcctcgcgtccgcgctcgttgccaccgcagcccttcccgatgtgccccccggtgccactggctcttcgccagtggccgagtttttaccctgttccccgggttcttcaatcctcgactccccggctccgttccccgcagtccggccatctccggtcgatctgccctccctccccagacctcaccccgcccagcctcttgtccatccctttcttcctccggtctcggtcattgcccgtaccccggccccctttcttgagccccacccttattccttgctcttttcccagttcctcagctctgtgaggcccactcagggaagccccactcccgagagcgggccctcttcaaccttggccaaggagggtgggatctgggcgttgttttccccagaggcttggccctgcgaagtgctgatgtcgtggaaggtgggaaggggtggtagtagaaaaaattaaatgattttcacctgggtgggaaattagtctgggccatagaggaaacatctgaattggagacgacttgagcatggggtggttgggggtgaaaggggtagcgtcggcagtggagatttttgccccttaggttagatggggctgtggcttgtcggaaaacctcattttgttctcttgactttcatcactgacaattcttttggcaatgttgatgatttttcaatctctgccagatgctatgtcatgatcattttacttggaatttttctcatctcacctcccctttttctcttttcaacatgaagcagcgtctgagtctcatggtggtacaaaagggaattactggggaaatgttaattattcattccttcttgagtattttccaatgatatattgaggattcatgtgagagaaggcttggaataacaaacatctttgttttgtcggatttcctttggaaaatggagtagagtaggaacagactcatcatctagttacctaa

SEQ ID NO: 7933 - DNA, 1161 bp, Homo sapiens
actcctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagcctctc

SEQ ID NO: 7934 - DNA, 1118 bp, Homo sapiens
tcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacaggtgaggggatgaagcctgggagtcttgatggtgtctactctgttccctccccaaagacacagacccctcaagggccagtgtttggagcatcgagatgactggaggtgggaagggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcgtgagtatggagcaagggtgtaggccccttggcccttttttctcagtgatgattgatcttagttcattcagccatatagttttttaggccccacgatccctaggaagatcaggggaacagagaactggaaggggccctggtcctccacatagttcctaagcacctgggctataccaggctctgagcagggcgtcatcccatcacagtcttcaacaccaccttgggagtaggtagtatcatcccagtgttatagaagaagagactgaggtgggaaggcagtgggtagagtggggacttggccaggggcacacagtagagagccagaaaacacacagtagagagccaggacactcgtctctaaggccagcgttcttccctttcacctccttagtatgccatgccaaccctccattttacacatgacgaaacagagccccagacaaaaggttgtctttcccagatcacatggcaggaagaagtaaagctgacctgagatcccaagtcttaggaatcccagtcctcagaaagccacttctctctgagccttg

SEQ ID NO: 7935 - DNA, 1123 bp, Homo sapiens
tcccacgttgagtgtggcccaaccggtcacgactcgctcccctaacgacgccctgtcgcctttggacagcacccagctacccgtagcaccgcctaccgcccaccggctccgtaaactccacccactcgcttcagcgcttccaccggaagtgcgcaacagcactcatacaaaggaagctgggtaacagagtatgagaactccgcagactcccggctgggaacccgacgactttcaccggaaggaggagcgctcttcagggcaatgcaccctgcgcaatggagtccacaaagggcgcatccctatgcgcttgcgcagctggaggcgccccccagccaaccccggagaggtattgtagcaaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtaacctgagcgatcaaagattgaggaaagcgtaataggagagcagggtgtaaggaattttagggagacccgcacccccgctggataaacaagaaaagggacgtaagaaggaagtagccagggaaccagaaggttaaaaggaagggcaattggccctccagagaatagaaaggaattaggggctggggtaggggccacagacaggcgattaatgagatgaaggttaccggtaggatgactgtagaggagaagaacaaacaatgatgggattggttttgataacgaagtgaaatgtatgtgtgtgtgtagctttcgaggtccacagggacaggaagaaacataaattggcaaagggattatatcatttgttgtgtgattgtgggcaagaatcacgttttatacattactgaatgaccaaggattagtacaaagcaggactcggtaaatgttagttgaatgaatgaagtatgaagggctgactatga

SEQ ID NO: 7936 - DNA, 1464 bp, Homo sapiens
tccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttattggtctggtctttctctgtggaattgtccttatttctgctgatatgggggcaggggacagctcattggacttagttgtcatggaactccagaaacccctttccctatagcccttcagtgtgttatgctctgcctgtcccctgatccagaatgcccagtgggatggtcagagccaccctcctctgcagccaggatgggattccagtcccatctctcctaattatcggctgtgtcgactttggtccagagcaggacaatctgtgcactgtccacatgatctcagtcaccatagcttcacttatgtgaaacttcatctacaacccaaatcatttcctgagctctgaacaggtaggcccaggttcctcctcctgtctctcccagatgaccaaaagccacttcatattgactgtttctaaagctgaatccaccttcccccggaaacttgctccccatgaaacttgctcttcctccagcgtttcctggctcaataagtgataggtatcacca

SEQ ID NO: 7937 - DNA, 1176 bp, Homo sapiens
gttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtacttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctttataataaaacttttaatataaaaatgatatgtttaatctttactgaaa

SEQ ID NO: 7938 - DNA, 1094 bp, Homo sapiens
gcctgtcatgagtctgtctgagcatgatacttaacatgaacttgatgtagtaggtgcacatttgcctaacaggataaattcagtgatagcccaagctggtcaggagagacagaagtgctggctaggaggtctcagcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaaaatgtcataaagggcactaaaagtaacatttgggtttcactccatatctagaagaatttagctcacaaaacaatttttgtgtgttttgagtaactgatgcataagtgcaatgaa

SEQ ID NO: 7939 - DNA, 1300 bp, Homo sapiens
gactttagcaaaaaaatacaaatgtaagttcatctgaatggagaatatgtgataattatggctgcatagatagttttttaggttatatttttaaaagtttataacatcaacatctaaattaatgtctcactgttaaataggggagaaatctgagtgtaaagtagatttcaaatgccagttgtcataattatttagctttttttgccatacaaatgtatttattatgtctagtatatcatgattttttattcatttttatttttctctaacttaccagtttttcaacaaccaggaattaggttagtactggttgtgaagtctgtaactgggaatggaatttttaggccctactctagtagctgtgcagttaaacattaggaagtatactcagtaaccaacagcatttatgtctgctggatcatttatatatgtgtgtgtgtatacatacgtatatatacatacatatatgcataatgtgtatatacacatatatactcattagatatatatacatactacatatatacatatatacatactgtatatatacacacatatatactatatacacattatactatatatacatactatatatatatacacacacactatacttgttataaaaaggaatatcgttttgctttgtaactggagttaaattgttatcagaagcattattaacaccccaacacaattattttgtttgtctgtagtgagatggtgtaggctttagagccagcccagcctaggttcccatcctgtctaaatttccaatgccacctcagtgatactaggctccctctctaaatcttagtttcttcgtctacacaatagtaatattaataataatactatccatacagatgctgcagtgaacattcttatatgaataaatgttattgttcatgtgaaggtatttttgtggacagaaatctatgggccaaaaggcatgtgcaatttaaaatttgatacttgctgtaaaagcactgtaaaaagactatcccagtttacattcctactagcagggtattacagtgctatgtaccctctaaacgtgaagagtctattcaatttttgccattcttatgcccatctttaaatgttagccctcttcaactctctttggcctctctatgaaatatcatggtatcttagacatgataatatcccagatattgttattcatatttttccataatagctattcatatttttatgtaggttatttgttagtgtgtgccatttatgaaacagaaactgcttgagtctggattttatatatcatccattagtttta

SEQ ID NO: 7940 - DNA, 2678 bp, Homo sapiens
aggcaattcactgataaagggccatttaaaggcatgggatatagctgtgagggagaaaagtgaacgttaattctaagcatcaaatagagactgtgtgagctcaggatcccacatagttcctaccttaggctagatctgatctcccagtgggagaaagattgagtcctaagtaagcatatttgccttgatcagagtctgaaatgattggggttagcaagacatcccattttcttcatagagtaaatgattcagcccacccatgttccatttttttctcatcctaccagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaaggaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatc

SEQ ID NO: 7941 - DNA, 1136 bp, Homo sapiens
tgtttgccttccaaacctagggtctaacaattccgtagtggttggaaaaggtttatgttactgttttctatatttgccttaggtccagtgtttctatctaaatatcttctaccttactcagtatattaattaagagtctttctaaaatagttgattcctctgtgagggaaatgcagggaaaaaaataagatagttgagacaactgaaaaaggacaaaaggcaactttttggggagactattttctataacaagcatttatcaacctcagtgggatgtagatttattagtaagtcttaaaaattaatatatatttagaccaccaaatatacattgagggtataaagaagtgtcagaaggagacagaagtgtatactttcctctacctttttgatagtatttaagacttagcgtttattctgttcttagctttgatttttatcatctatttatataacccacatgtattgtgcctcctgtgggtcttcctagaaagtcatcttaaaaagtattttcttttccctttctttcagactttatattcagagcaccaatcaaattaagcaagcctggggaacttcgtgaggaatatgaaagcttgagaaaggtatagtattatcatgtcattcattttcttaaagtagattgaaataatgacattaaagaatgcttagtgggagttttgaccaggttttaaaaaatttataatgcagagcctttcttcacactgccttataccagcctagttagatttggagctataatggcagcagagcaaaccttaacccaagattccctttttagttgtcttttcaaagatgaagacgtagttcacagagcctgtcacatgccagctgcagtaactggccaccagagaagtattcttggtacttttaacaggtgcccttgctaataattgcttgtattatttttctttatctcacaagtttcttctaattacatgtagctggtgttatccattattgctcactccattaaatactccaaaagaactgtcttgtaggtcagtaaggagatagtgaaataatttcctagttagaaaacaattaccattgggaaagcttttatctgtgtccatatcatcttatttatgatgttttcaaactaattgtctggg

SEQ ID NO: 7942 - DNA, 1223 bp, Homo sapiens
cctaggcaggcggattgcttgagccctggagttcaagaccagcctgggcaacatagtgagaccccatctctactattataaaattagaacaaaatttctttgtagaccgtgtatcttgacttatcctgtaactgcaggataagagcataaaaatgtaggacattagaactgcgttaagtcactcttttgttgccaaggaggcctcgtccagcttctctggctttctgtggccatctctgctcttcttctagtccaatgcagttacatctggcttatgggaataaggaagattttcaggcttagccctttttggctatgtgactatactttattttttgataatgtgtattatcttagcttttatgatttcatattgcttaagaatgcagagcagttaaatctttagccctgaagagtatgtttggcaagagccaagtaaaagtagatttacttagaaatcaagagggctctatagctgataagaaaaacagtctcaaaactgccatgtgatctgtttgttctaataaactacagagtaaaatatgtttttaagtttagagttgcctaaaactactgtgtttgcataatttatatttttagctgagagaagaaaagttacaagaggaaaaaccctctgaagatcaaatccacaagctgttaccagaggatacagaaacagggaaaaggaaaatggatgaacagaaaaaaagagatgaaccattagtactgaaaacaaatctggaacgtgtaagtaaatcacctttttaatggatacctgcctcaaaaatcagtggttagcccaggtgacctggacctgaaagacctatgttggtaaattgtgagaccagtaacagtcagtgactgtgcagcttaagagtagtgaagaacttacgtccaggccagagcttgagaaaataatttttgaatgggatattaagacttgtgggaagattaaggaacagtgggaaaagcaggtgagtgagaggaaaaacctagtatagtttactacttgtgattagatttatatgtatgttgttatttggacttatgtgttatttgacatttaagatttgtacattgtcttctgtcctcaactagattttcttaaagcatgtattttactttcctttatttgttgtaataccctaagcagcacagtgtagatataaggtaggtttagatacttagtctatattcaattagacttctaattgggccaaatc

SEQ ID NO: 7943 - DNA, 1105 bp, Homo sapiens
taacatctcttcagaagctgcttttagcttaagccccaagaagtgaggtgggttgtggatcactgacatggtcaggggaggcccacacctcaattcagtaaccacctaatctctcccccaacctgatctctcatcagagctggcagcaacttgggattcctttcctttttcctgcctaacttttcattgaaatgtctagtaggagagtgagaaaagagaacaaaggctgggtcacagtcatagaatgttacagctggaatgggcatggaaatcatccaagttaaacttcttctctgccccccgcccccacttttttttttttttttttttaaccaaacgaacttgtgatccagtgccctattttatagtgtggttttccagggtctgaataaataatcattaaagtttgacacacgcagacacacgcaccaatgatggggatacccccaaatgatttaggaggttattttattttaatagttttttcttcctgatttttttcagttagttagagttaaatgtacctatagcccctgaatacatgctcaggtagagaaagtctccatagtataagtaagtaatatgaatgtggaatcttggaaagtgatatattttgattggaataattttaattaaatttaatgattttaattaagaattaaaagccagctagccaaattttctttaaaaattggaaactcattatggtcttaaattgtcctcaggcagccttttcctcatcaacccatagagtggtcttttgaactggtatctaaacatacctggttatgaattctcaaaagagaaagcaggtctggggcggggtggtcaggagacagattctagggaaagtgctgaagagattttcttctgaagatgatctaggaaatgcatctttatacatgattgttagctgctgtagctttctgaagaagattgtagaaaagagactaagatatatgcaagggtcaccagtttagagatcagtcaaattggaaaaagtgccaagactggatgtgcagattgttctatgtattatcagtatttttttcctcttaagaaaaaaatttactctctctcctttgtgagtaaatgcctccttaat

SEQ ID NO: 7944 - DNA, 1099 bp, Homo sapiens
aaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatc

SEQ ID NO: 7945 - DNA, 1339 bp, Homo sapiens
caaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtga

SEQ ID NO: 7946 - DNA, 1119 bp, Homo sapiens
cggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagaggatgctggctgtgctttcatttctgtctcataagcccatggcaggtcaaagaccaagaaatgcctccctgctgccctggactggcagatggggctcatgactgggtgaggtgctctcttcccttgtctgtggccccagctccagcctggtccttgtaccaacttctggagactgccaaaaacttttctcctgtccctcttctgccacttttcagccttatggccttgggaagctggcatacctctcatccctctcagataccacaggattttgtgacccatggtttgctcctggggtgaagccatcctatcttctatctttggcaccactgaccacatcagtg

SEQ ID NO: 7947 - DNA, 3054 bp, Homo sapiens
cagcagtgtattcttgccttaactggtcgtttctgggtacagtccgctggccccaggacctcaacttgaagggttgctgacggttgcttgctccgtctggggaccccgggaggaagctgcctcggatttaacgccttgtcattacatgggatagaactgtgtaaaaatcattagctttaaaaatagacagtttgtcatttcgtatatacacttcgatgtcaaaattaaatccacaacttctcgagagttaggatttgccagctctgttggtaccgtaaagccaaataacatggctgggattctttagacggtgcaggttgtgtctacaagtgagagagcttatatgttaagtctactatctattccttaacagtgacaagtacagtgtctttgctgtgctgaatgaagtgtaaataggccattagagcagtttcttgttttgcatgtggaactgttttaaacccttcgatgaagagatgatgacgagtctgacttggggatgttctctttgcccaggtggcctactctgtgctgcgttctgtggcacagtttaaagagccctggttgaagtaatttcctaaagatgacttagaggcatttgtctgagaagggttgctgcactcctgttggaacaagggtttggaaccattggttggaggtatttagttttggtgagggatgcattgactaataagactagactggctcaggcgaaagtgagcctacaccgatctcctaattttgaactttgctttgtttggattagtttgtcgctgatggcatcttcaaagctgaactgaatgagtttcttactcgggagctggctgaagatggctactctggagttgaggtgcgagttacaccaaccaggacagaaatcattatcttagccaccaggtaaaactcatttgactggccatcacctataattgttataaatgctaagttggtttatttatttatttatttttttgagacggagtcttgctctgtccccaaagctggagtgcagtggcgcgatctcggctcactgcaagctccgcctcccgggttcacgccattctcctgcgtcagcctcccgagtagctgggactataggcgcccgccaccataccttgctaattttttgtgtttttagtagagttggggtttcaccgtgttagccaggacggtctggatctcctgacctcgtgatccgcctgcctcagcctcccaaagtgctgggattacaggcgtgagccaccgcgcccggcaggtttatcctttatgaacttaaggggacagacggaacagtgaatctgggcttagtgaatgtaattgcttcttaaaagctagattttaaggccaggcgtaggatcacttaagctcaggaattcaagatcagccggggcaacatggggaaacccccgctctacaaaaaataaaaaagggtgtggtggtgcatgcatgtggtcccacctattccagaggctgaagcaggcgatggcttgagctcaagaggttcaggctgcagtgagccattggtgtgatccagcctgggtgacagagtgagaccctgtctcaaaaaaaaaagctgcgttttaaaaattttagtttttgtcaatgaaaattatatgctttgtggcagagattttgctaccacacatatatgcaagatttaaagttacatctagcatttgtgagaatcttgaattgtcacttttcccccccagaacacagaatgttcttggtgagaagggccggcggattcgggaactgactgctgtagttcagaagaggtttggctttccagagggcagtgtagaggtgagtgattctggcatatgccagaggtaatggctcttcagaatgatacttctaaaaactctcaacttggagactttaattgtttgttcattacaaatggactggtataactgttgaaattctcttaatgaataatgggcttaactttgtaagcctattctgctaatggctgatggttaaaggattttacattcaacttgggtatagaaatgatgcatatgatggattaactgtccccattggtgtacttggcatggccaaaggagccagggtgggagggcaaggaacctgcattgtgtgtaggtggtagaagtgctttaggaattgagggatactgaaattatatgctgtatatgatggtggtgtccgatcttttggcctccgtaggctacgttggaagaagaaatgtcttgggccacactactactggtagcgcaaaaaatcacgatgttgaatttgtgttgggccacaatcaaagccatctcctgggcagcatgcggcccgtgggttgggcaagcttggtgtagaaagtgatacttgtgtggcaaatgccaaattttcaactttcagttgaaaataatggtgatggtaacaggatatcccttgcttcctttaaagctttatgctgaaaaggtggccactagaggtctgtgtgccattgcccaggcagagtctctgcgttacaaactcctaggagggcttgctgtgcggaggtaagtgtcctgagacctaatggtcatgaccttttgtgtgtatcaacatacatgtctgccatttgttaatttagcagatgaactgttacaaagttacaggatctgctagtctcccagggttataataagatactaagtcatgccctcactgaactggcaggctaacaagactactaaagcagcaagaactgtaaagggtggtcagtcctgtaatggagaagtgttctgggtgctttgggagttaaacacaaatagaactgtccaaggaggggaccaactcctgttggtcttcttgagaaggctttacaaagagccctgttgcggggggcggggcagtgggcaatgaggaataattaggcctgttactgggtgtgttacgtatccctaggtagaagtgccttagtactagttaggataccatgaaactttagtagcaatcattcaaatctgcttagtgtgttcactcttaagatggtattgtgaagagataagatagacctgatgcaaaatagcttaaaatctagacacttaacct

SEQ ID NO: 7948 - DNA, 3054 bp, Homo sapiens; identical to SEQ ID NO: 7947

SEQ ID NO: 7949 - DNA, 1954 bp, Homo sapiens
gaaagggcctggaggtggctagctctccagttagtatctcgcagagcgtaaactgccgaatgagttggggggtaggtcatattttaaagtgttttatcagcgttctaatagcaagatagccaggatcctaggtgggtaagctttcctagtgaatgagacttcggaggttgcagagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaagtctttgttttgttttttaaacttggtggaggtccttggcaataacacagtggctctcttctgttcttttaaagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgagcagctgagagtgcttggcaaagggcatttgtggacagatttggttttccacagacatcttaagtatttgggggagtttatcatggaagtagctgggcatgttcatattccttggtgtatcgattgccacgttgatctgtaagaatcgatttgctgagatctgtcagatccaagagttggtttgtccttgttttagccatctgtgtacccttcagtgatgacacgatgacgagtcagaaaggtcacgtcctgctcttggtccttgtcagtgccatgttctgtggtgctgtgcacgagttcctttggcagaagtgtcctatttattgatcgatttagaggcatttgtctgagaagggtccagacccaggggtgcttgagtaaactgcttgctctctttggtcttgtgtgatgggggcctttgagaccccagctgtgtgctaacaactgtggtgtcctctaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgtgggagaatacaagttgaaacctggggtctatttaacccttggttccaatgggacaggtgttgcctttattctttccagaaagaagttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcag

SEQ ID NO: 7950 - DNA, 1954 bp, Homo sapiens; identical to SEQ ID NO: 7949

SEQ ID NO: 7951 - DNA, 1318 bp, Homo sapiens
gggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcc

SEQ ID NO: 7952 - DNA, 1116 bp, Homo sapiens
tctaaagtgctcattgaatgaaaaatgagtgagtgaatgaatgatgagattcactgtctgcctccacattcaccatggtgcttccacaaggctcttctctgactattaactgtctctgctcccatgaaaggggcagttttgtgagaggtcacagcaactgcagaccagagagcagtcaatggctggttttatactggctggcctctgttcaggcctgcatacctctgtactttagatagccactttttctaaacagtcttgattgcataaaatcatgggcccttggttacagggtaatctaagaggttggccaatctcactccctgctcagttcagggctcctaactctagggtgacaggaccctccccaccaccacacatttcacaggcatgtctaattccaagcaaggattataaccaacaggcctggttctaaatccaagctctactatttactagctgtgtgaccttaactgagtctcttaatttctttaagcctccaatagataacaataatacaaatatcgatcactcttcgaatatatttggttcccaattcaggaagcaagaatttggccagcaagggataattttatttatttcgacctgtttgttttcagagttcaggatagcaggtggcaagagctctgaaagcaagggatacctgattcccaggcctgcggtgagggccccatggggaggcatgcaaaagtcctctgcaaactggagtgtgcaatgccctcgccaatagctcatgttatgggtagttttgctgaccacagcttcccagttaattactgcccctggtccctaacagtatggcagctggagctacacaaggtgaatccactcctgccacacaatggcctgagattaacgccatctagtgttggctcttgctgcctcttcccgtcccccagcctttcatctggcccctgctctctaagcacaccctataaatcagctggtgcagatccatctctgcaattccacattcatttggagtgatcccctctggatgcaggaaaccaattttgattaattgctcaagatccgatcctttgctttagatgggggttgggggaagacaatgatgatttgcaagttcccaggagc

SEQ ID NO: 7953 - DNA, 2676 bp, Homo sapiens
ttgaactttaggtacatgtgttcttttcaaaaattcagagaatcgtcatgtgccacagaagctcagcctgggcttcagcaattgacaaaatttgaagaaatattaaacaaaaataacaaaaaaagaaacaaccttggccttaatgtcaataaaagggagttgtgtctgttaagtggtcttttcatagaatcgtccattagaaatgtgtgcctgtgtttagcttcctatcagtgggctttaaattgtataccgagtcatagatacgccactgataactaaaactagatcagggctggtgaagaaggttaggtgttttaggtacattccagctgtcataggaagatcacagaaatgaggaggctgttttcctctgattctcctcggccgaccacctgtccaatgctgctggtttcgcagagcgaccggttggagatgtctgaggaagaaagttcaaggtgtagggatagtgtgtttggaatttgactttccatttctgagacccaagggggcgtagatgtagtggcaagtgtggcgatgtttactctcccttcctgaaccgctctggtctgctcctcagagagggcagcggtgccaggcctcaggtcagggagaatgtctgtgacttagctgcagactaggagactgccctgctaactaattagcaagcagctttgacctcattaatatataaaagcagctctcagtatattccgtgtcgtgtgtgtgtgtggccaaagcccccaagggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttccaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacgaacaccactttcttgatcttatttccttggtgaggcccacctgagtaggtgaaggaatgaaccttttgcatttgagccattctctgcaagatgagctgtgccctgcagtcttcctggggctctcc

SEQ ID NO: 7954 - DNA, 1159 bp, Homo sapiens
gcctccttgggtgatcctactcagtttatgatttcaagttggcaggacttgctttgtttatggatgagtggcctgtcagtcaaggaatgaccacatcctttgaatataacgcactccagatttggggttgtaccttgttccatatagcctttttcctcaaaacaacagcttagctgtgcagtaagcatgtcgtgcttcacatgccatgcttcacattacacacatactggaaatgactggatttggtgggggaaggctatgccctcggagctggtgagaatgattatttttagcacctatcaattctattaacctgtcaaaaaaatctttgaacacctcaaaaaaatttttaaatttaggtcttttgtaaaatttaattatacctatggctttcgggccaggagtactattttgctatataatcaaaagggttttgaaatattaagggaatgattattgctaagaaacatcaatttcttcaatgaacaatttaagtgcatgacaaatttgatgtgaaatttaacgggttttttttttgttccagaataaaaattaacaaataattgagaaattcactttgattgaaagtagatataaagaaataagctattcaatacattaaatacactgtaaagaaaaaatggttggcaattataagcttatctagaacattgattttccttccctattgtctcacattcttttccttgctatgtttctaggatatcttctgaatttaagtaagtaccatgtccactgacataagatgggccttatgttgccttagaaggcttagaagccaagctgtgctccacttcaatgataatttgatttacaaacccttttcttctgccattctacataaattatggtgtattcacaccatggtgactggttcgtctcatggactttacaaatgacacctgccacatgacatcaatgtgaacagtctgcttaaacagaaagggacacacagtccatcatgtaaaatatacattcaaaattcagaatcatatacatgctcattgttttactttacaatttacagtcataaataacattagataccctttgacattatggttttgagaaaccttccctattcaatagctcatctaattcccaatccattcatatcagcctgagatttttgcattca

SEQ ID NO: 7955 - DNA, 1226 bp, Homo sapiens
cgaacccaccgggaggaacgaacaactccagacgcgccaccttaagagctgtaacactcactgcggaggtcccagcttcacacctgagccagcgagaccacgaaccccaccagaaggaagaaactcccaacacatccgaacatcagaaggaacaaactccggacacaccgccattaagaactgtaacactcaccgcgagggtccgcagcttcattcttgaagttagtgagaccaagaacccaccaattccggactcaaaattatattcagtatgtttagtttcacatattgagaattataacatcttggagttggaggagatactatacctcattgagtccagtggatcatccagtatttgattcctcctgtgttagtctctcaagctactgtaaattaccagaaacttgatgagataaacagcagaaatttgcctcacacagttctggaggccagaagtccaaaatcaaagtgtcatcagggccacactcctttctttatcctttccagcttctggtggctccaggcattgcccggcttgtggctgcataactaagctctgcctccatctgcacacaacctcttttccctttgtctcacctctgtgtttccttattacgatacttactagattgagggcccacctgaataataaaaaatgatctcaactcaagatccttaactattttagatcttttcatcaaataagttaacttaggtcccaaggattagaatatggacatatctttttggaggccgccgtgtaacccgctacatccactgaatacatgtgcattgtttgtgtttgtcgcccttctctacttggctgcctgtaaccaagatctttaggattttgaataactctgtagtgaaatcaatctcctgtaacgcatataccattcactttggttctccctgcttgaagccatgcagaaaaaaacgaattctttttctctctgaaagtccttcatttgttgtccctgagactgctatcctccaggacaaacacctctggttccttcaacaatttctctcaatactgacttctgttcccctaatcatcctgggtttgcttctctaaagcattcagaggcagtagagagaatactggatttattattgaagacctaatactgaagccatgtctcttccacttcctacttaggtgaccaagccaaatcagtttattttaaataacaataatactgactacttcattgtttcac

SEQ ID NO: 7956 - DNA, 1203 bp, Homo sapiens
ttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaagcttaggcacattattttttgtggggtcaaaacattcttgtgtaaattctcttaaacatttgataaacagcttcacaattcaaggtgagtcttttgtatgtggtttactacttgggttacagaaaaaaaacaattaagaaagtgttaaatgtaagattcacccaactaggtttttttttttttttaaatgtactgtgtgggccctgatgtaaattgtcagagtttgtcttattgttgctggctaaaatgaatgcagaggtgttaatgaattattttatgttgggagtaagtgttacttgagcttcagaaaccagagtggtgtgtatttgctgaactgctgagaatgatagcccacagtccatttctctgtcctaggaaagcccacagatgtgtcaaatcaggacacattatgcatgcggcttatcaaaaagataacaagagtttatcttatagccagggctc

SEQ ID NO: 7957 - DNA, 1177 bp, Homo sapiens
attctttaaaagttgttgaagacattgtaacattcctttggagatatcttgaatttttaatagctcaaattaaactggtcactgtgttgtgctattctgggtagatgtgtcctagagcaaatcatgttatgtactgcttattcaccctttgtttttaggttgatgaactcaagaccacagggaataccttgaagaagggtataggaaataccttaaggagagtgtacaagataaaaattcagttgtttggcttagagataaaaaggagatgatttttgtgttattgtatgtaagtccttcttactaggctgctgagtatggttatgcaagttgtgcactaaacagccatacatagcaatctgcttttttcttttcaattcactgtctacttagtcactgccagtgtggcaccccagaggtctggttcattattcctgtggacaactctggttttggtacttgtttgtaataaaagttaacttttcccctgacttttttatgcagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactggtaggtgtcctcttaaaatgtagtattaaggtaggagaactaccttcctggatttcatgggatgattgtgtgggggagaatatattctttatatttttagctttttcctctttgttttcagagcaaattcacaccatccttgggatttaccctgtctttaatgactaggaaaaaaaataggatgttatgaagtttgtaggtaatataaaactacaagtcagccataaataacaactgtgaatatacagcaacagttgtagggagaggataaaatatcttttgtctaagaatgagttttgtttgttttttgtttgtttgtttgttttgagacagggtctcacgcccatcgctcaggctggagtgcagtggcgcgatcatgattcactgcagcctcaacttcctgggctcaggtgatcctcctgcctcagcctcctgagtagctgggactacaggtgtgtgccactatgcctggttaattttttgtatttttagtagagatgggatttcgccatgttgc

SEQ ID NO: 7958 - DNA, 1098 bp, Homo sapiens
gttagaagaggcaccataaaggagtggaaagattgctttcagttgtacaagatttggatttgaatcttggcattaaccctgaccaactgtgtgactttggttaagtcatctaccctctcagtttcctcatttgtaaatgggaataataattttcttatagtgttgtcacagggatttagcagaatatgatgggatttagtagaatgtgatgtgtgaaagcaccttgcacagtgcctggcatgtagtagttgtccagttgtccaaaaaatgtcagttttcttttttttttttttcttgatattgttggggaagttattctgctaccttttcttaccataaagattctcctgtgtcttctcttccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttg

SEQ ID NO: 7959 - DNA, 1230 bp, Homo sapiens
acaggtggtcagcatggtggaccagcagacgcaaggtcttgagggtggtgaattggaagtgaacttgaggctgggaaggcagggaccaaatcaccaaggccttgaatgtcaggccgagaagggggatttgagcctgtaggcaatggagagctcctggaggatttaaacaggcacagcagggtgcggttggtaattctatgaaacccgtctctggcttgtgggtggtgctggaggccgagagaccaatctggagggcgagtgatccagcctcttagagtcaaagggacccagattttactcccaccccattgcttcctacctctgtggcctgggacaagtaacttatttaaaatgtgaggatactaattcttgctccactgatttggtgtattaaataagataatgaattacatgtgcaaataaataaaaagtggtttgtagtgtgtattacattgtgcagacattcattggattgcactgacaatagaaggcagagacagcattgactctggtcctaaacctgatctcaccagcgggcagagccctaagcatcctgcagggttgcaccaattgttatgttccccacaaagcagaagggagctttctgtccatgacatttcattcatctgatttatcaccttcatgtggccaggctcgtgcaggcaaggaggtagacacagattcgtagatggccacagaagtgggccagtaccttgtcgggggcagcccaagggccatgggcgctcacaggatgggtggcctttcctggatgagcggcaggttagactgggaaagcctcacagaggaggtggctttttgaatgaaatgtgtgagagtttgctggtagacaaagaagggtatctttgcatcagagggaacaacgtgtgcaaaaaggcaggtggctctagaagagtcacaggcctctagactagaaagctgtctctgtgggatgggttttaaagagggagctgtagtagggtcccagacttctgttgggaagtgcgttctggtgccagcatggctggcagttggagtcaggccaggagcgaggctgttgcagcaggtctcttgagcctgacctggacagggggaggtgactgcccagcttagggatgagggaaagggaagacagtgaccccaactgcccagggggatctgcgaatttgatgctgagccctcattctgtcacaggcaacacagcagcttttgcctgctttggtctctgagacc

SEQ ID NO: 7960 - DNA, 1204 bp, Homo sapiens
catggacagtgaggccagggccatctgccttctctctgcttcattgtgggagagagagactgagaaagaccaagagagacacagagacagagattgaaaaacccagcatccacttcctccagagtcagggagacagagatgatggggcgtctccacggggagtccagcaagccggcattcactgctccctggccttggtgccctttgccggagcctgtgtctgggctgctggtcccataacacgtcgacaaccctcaggatatggggcagggttgctgcaggggtggatttgggcagtggagagtggctggcaccctggaggctgtgtaggcccagctgtggctcttctgggcctgacttcagggtggagaagtgaagggggaggttacacagagatctgtctctacgcacacatatccatgagacagagtgtgctgtattcatatggatgtattctagaggtctattcctaccctaggaacaagtgcagttttagattatctgttcatcattgctgctggttcaaggatggctcttaacaggggcctggtccggatgaccttggcctgggggcttgctgagctaggagactgcagttcagatagtgaaacagggagtggattagtaaagggggttccctttgccttgagggaagttggagctggagagagtggattctccagggcctcaggtatcccctgctggggagtcaggctctttagagcttgcaggtcagggaaggcaagtgcttcgtcctgacatagcatctgttggcatttcttgggcttcttcaatgcagctgaggggggcagggcgaaggcgtggtgggcagttacgacggctgatagtcccaagtgggctgcaggcggcagtggtgtgacggcagaatggtaacctctggggtcattggatgcaactcactcaccaaacagatggggaaactgaggcacaattttcatcagattcagttctgactcttagcctcattccccttcgcattgcgcagtcccagagagcccccccttttgggggagtgcctgacctgcacctaacatcagccaagtacagctaagccactgtccccagcaccctgacttaaggccagccctgtgttttgtcctcagccagtcagggatgtgtccaagacatttcccctcatgaagcaaagctgtcaaggaacttgcggctctggaacagatgcact

SEQ ID NO: 7961 - DNA, 1140 bp, Homo sapiens
cattttaaccatatggaaacatacaattcagtggcattcattatgatcacagtgctatgggccatcaccactatctatccccagaaccttctcatcattcccagcaggaggtctatacccatccgacagtaactccttcccctccccctgaccattgttggcactttggaaaagagttgcttttttttttttggacagctgattttttaagattgagccactaaggcttaggggaatttaagccttatatgttggcccgagtgttaagaactgggttccagtgttggctccgccgtggcctgctgcgtgactgtaacaggttgtttgacccctctgagtttcaaaaacctcccctatgaggtaaaggatgcagcctggctggggagcatgagctgggaagtctttccacattgcttcccagactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggtgagaacacggcagtccccagaggcgacccctccccttcaccctcgctgactgagatgggagacaactgtgacatcccacgctcaggtcagctcctacgtattcagaccctcagcctcgtgggggaggggagaagttggaaggtgcaaccccctgcccagaccctctaggctgtgaaaagcctttcccgcactgttcaaccaaaacttcttttctgatcctcttgggttatgaacgtctgtgcatctgagggtggtcctgatttcattacttgctcgtgttttggatgagaaagctgaggcccagtgaaagccaagttcaaacccaactttagcagaccctgtgctgtgctggtaaactgcctccagcaaagtaaaaagccccggtttgtagcatttgctaattactgtggtgtaaatactcccaccatggctgatttccaactacccacatttaacaaccagctattaacaatattcctggccgggcatggtggcacatgcctgtaatcccagctactcgggag

SEQ ID NO: 7962 - DNA, 1221 bp, Homo sapiens
caaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtgtccctctgtccccctggggggaagggacaatggaggaatattccccaggcctgggcgactgtccgctggtcagagggaaggccccgctgcctgcccggtgcacctgtgagctgagattgtggggatcattcagtcattcctttattcagtagatctgtacggggctggctttgtgccaaggcctgccccgggcacctgggatgtggggaaccaggcatag

SEQ ID NO: 7963 - DNA, 1222 bp, Homo sapiens
aatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatgg

SEQ ID NO: 7964 - DNA, 1099 bp, Homo sapiens
tttaataaccctagagagtaggtacatcttctttgtatttctgtcttcagcagtagcctatatgtgtgtataaataaatgttcaaaagtatcttcctggaagcctatttggacagtatattatcttcagcagattcttttttttttttttttttccaagacaaggtcttgctcggttgcccaggctggagtacaatggcgtgatctcggttcactgcaacctccacctctgtggttcaagcgattctcctgcctcagcctcctgagtagctgggacaacaggcgcgtgccaccacgcctggctaatttttgtatttttagtagagatagggtttcaccatgttggccaggctggcggcagatatattattgattccattttgttttttctaattgttgtatttaaactttaaagttttctgtttgtttagaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaaggtgagtgtccttttgcagtgtgaacagtcagatgagcacttgggcaataagttatggatagtcaatagaagttcttttaataactaagagaaagaattgactctctatagtataggaagcagatacagaattacatagtataggaatgcttatgtcatttgtttttagtgattttttttcctcattaccaaaaaagtctttgttcatagtcaaaaaaatttttttaatgtgcgcaagaaagtagaagtgaaaaagaaacaagtgtaattctaactgagagatatccactattaatttactgttgcatctgtgtattagtttgctagggctattataacaaagtgtcatacaggctgggtggctcaaacaatagaattttattgtctcatagttttggaggctagaagtccacgataggttatctctgagggctgtcaattcaggcatctcttcaggtatacacacacccaccaaagcaagagagagattttaaga

SEQ ID NO: 7965 - DNA, 1173 bp, Homo sapiens
agcagtcataagccaaaatgtaatgagcttagtatataaccactttagagtatacactcaccactttttgtattcattcatgcaaaccctcctggaagtcgattagaagaggatccaatttgtggaccttttttcctccttttggacacctgagcacaattttttttttcctttcatatttataccactttggaaaattcagtaaacccaattctggcacatcataatggtttcagttagtgaagatgtttattttaataactttaaaatatgactatcctatacataagttatataagagggcataacaatagatgagtagaaatttataaaatttcttggatattttgaatgagaaaaaaacatttttaaaggaattttgttttttccttttttggccaaaccggtacaagttagaaagtgtgctaaggactgaatacttgcctcgtgctttttgccactggatgatgtaagttaagaatggaattgttaatcctaagtatatattttcttgactttcatcagtttctaaagaaatctaatttaagtgttttgcggttttgtttgatctgtatttattgagttctggtcatagaccagcagcttgcacgtcatgctcatgaacagccagaacatagttattggggaacttcatggctcaaaaccttctgaatcatttaacttattttgtatgttgcaaaaaaaaaaaaaaagtttattttgcttgagagtcacctttttttaaaaaaaataactgtacagcttttaagggatgggaggtgggaaaataccctaaaataggatgtagattttttacaattgtgtttatgctagatcatctacaggtgcattatgtaattaaacctaaaattgtttaaaaatttgtgccatgtctttttcattctcctgccctttagcagaattggtgcatgtcaactgctatgtggacaagccttgaaattagagtaacaagccctgtctccaaagctttaaggtcactgcatgaaaattgcacacacacacacacacacacacacatctagcttatattagtaaatggattttcaggatcagaacagctacagtagcccagatttggctgttaacagcatattcttacagcacatgatttttgtgatgcctaactagggtattctcaatgttagtctggtg

SEQ ID NO: 7966 - DNA, 1471 bp, Homo sapiens
caaaagttatctagtctttagggttccgttttctaaagctaataagtcagccttcttaatgattgataaatttagaaatataactgaactttgcaaattaaacatcaaatggaatttttaaaaaatgagaatccaccaaaaagggataattttacatagttgatctactgaaaatttcataccatgacatcaccacagtcttaaaacttgtactgttacgtagcaacttccatttctgcaagttgcaaaattaataatataaatatagagacgttctttgccgagagtcgtcggggtttcctgcttcaacagtgcttggacggaacccggtgctcgtcccccaccccagccggccgcccatagccagccctccctcacctcttcacggcaccctcagaccgccccaaggcccctgccgccgccccagcgccacgcagccactgccaccgccgccacctctccttagtcgccgccatgaggaccacgtccacctcacaggtgcgccagaactaccaccaggactcagaggccgccatcaaccgccagatcaacctagagctctgtgcctcctacgtttacctgtccatgtcttactgctttgaccgtgatgatgtggctttgaagaactttgccaaatactttcttcaccaatctcatgaggagagggagcatgctgagaaactgatgaagctgcagaaccaacgaggtggccgaatcttccttcaggatatcaaaaaaccagactgtgatgactgggagagcgggctgaatgtgatggagtgtgcattacatttggaaaaaaatgtgaatcagtcactactggaactgcacaaattggccactgacaaaaatgacccccatttgtgtgacttcattgagacacattacctgaatgagcaggtgaaagccatcaaagaattggatgaccatgtgaccaacttgcacaagatgggagcactcgaatctggcttggcagaatatctctttgacaagcacaccctgggagacagtgataatgaaagctaagcctcggctaatttccccgtagccgtggggtgacttccctggtcaccaaggcagtgcatgcatgttggggtttcctttaccttttctataagttgtaccaaaacatccacctaagttctttgatttgtgccattccttcagatgaagaaatttggtacccccccccaaaaaaagtaataataataatataaatatatgtattagatgaatagataggaagcaattaacttatatataattatactttaagttgaaacaagatttagtatgtgatttacaaaacaatagaagtagttaagtttcattaaaccatatgaaattgttaacatttgaacattttgacctataaaaatggtgatttcatatggctcaatcaagtattataacaggtttcaatagcaaaaatgtttaagctccagccagtgtcctacttattccagttaat

SEQ ID NO: 7967 - DNA, 1189 bp, Homo sapiens
gtagagacagggtttcaccatgtgaactggtcttgtactcctgacctcaggtgatccacctgcctcagcctcccaaagtgctggtattacaggcgtgagccactgagcccagtgctttttttatttttatttttttaagaaatgccataacaggccaggcgctttgtcacccaggctggagtgcaatggcgcaatatcagcttactgcaacctctgcctcccaggttccaatgattcgcctgcctcagcctcccaagtagctgagactacaggcacccgccaccacccccagccaaattttgtatttttagtagagacagggtttcaccatgttggccaggctggtctcgaactcctgacctcaggtgatccacctgtcttggcctcccaaagtgctgggattacaggtgtgagccactgcgtccagccaaaaatgtaactcttaatacacatggactaatttttgctttctttgggatttgtcatttgaatttcaggtttgcatcgccagcttctatatattacggcctttttttttgctggatattatcttgtaaaacgtgaagactacctgtatgctgtgagggaccgtgaaatgtttggatatatgaaattacatccagaggattttcctgaagaaggtatttcaagttaattttagataatctgtgtttactgtattattattttccctggttaatcttatccatgtgtatggctttagataccttctaaattctgttgactcccacatcttagtctatagaccaaaattctcttgaattaatatatccagtttctgactacctccgtgtcctttggacagcaaacaaaactcatatcccctctgccttcccaaacctcctgctcctctgtgtcctgcttcagagaatggcactactgtccacctggacactcaagccagaagcctgagaatcatcaagtctttctctttcacttcccattagtcatcaggtcttatcagttctacttcctaaatatttcttaactttgaactctcctctcccactaccactaccctggttcaggccttgttaatctcttgcttggactgttgcacttgcctcttaactcaccacttgctttggtcttatttccaatgacagcaaatctgatcacatctgtttaaaatagtcatccggctggtcgcagtggctcacgcctgtaa

SEQ ID NO: 7968 - DNA, 1189 bp, Homo sapiens; identical to SEQ ID NO: 7967

SEQ ID NO: 7969 - DNA, 1221 bp, Homo sapiens
ctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaaccttcacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgtttacaggtgtctggtggcctttgcttggagataaaggcttcctcttgcctgtcccagcccccgagccatcctgggtttgcacttccctgctggctgctatcaggatgacctgggagaggactcagtcctaggccccagggtccctctaaatccctccaggctgcagctctgtcaagagggatgtccagagggtctctaagaccctgaagcttgactttgcaattgcatgacaggaataaatatcacagctcctctgacatcactagt

SEQ ID NO: 7970 - DNA, 1055 bp, Homo sapiens
tttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagc

SEQ ID NO: 7971 - DNA, 1167 bp, Homo sapiens
tttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgaca

SEQ ID NO: 7972 - DNA, 1135 bp, Homo sapiens
taggccatttttcgtgtgggctgtccccatttttcattgtttggcattccatagctttgtttactcacccctacttaataagtactctctttcatgttcctatcttgtatcctgcatctcatggactccacgacatctgtaagaatgaagaaaagcatgtagcctcagttaaaatttcctcttcccaattttccacttggctgtgcaggctccagaagcatatttcatcttgaaccagagaccacacggatacctgaactaagaacacagcctctcatccactagtctttgaggctaatatatagtgatgaacaacaatatctgttctatccagagaattgaaaaaatataatttatggttttttatgaagagagtaagaatatttaaagaaccctagggattcctgataaggccacaccgttgcagtccggtcctgtctgatggacttttgattcatgtgtgaaattcagctggggctggagtgcagcctggctgaaggcatcagatccttcaggagactgcccagctacccggcctttgcagaacacactagtaggaggtgtggagagacagagaaagagaagctcctcaaagagctataactacagcctagggagggcaggtgaaatggtattagtgattcatgctgggaattaagaggcctgccctgctctaaacacacagccagacacccatatatagacacagtggggtttatttcagagcaacctttgatgctcatcctcaaataagcaaaactttagaaggccaaataactcaaggcttggatacaacccctccattggaaaacaaagcacacatctttctttagggttaataagcattgagaagtggtcagattttctttgctttgtcttgtttttcacagtgacatccattgacctgcacctcatagtctgtgtacgatgcacaaaggaggaatgcatcttacttagaacgctaagcattttgcattcaagcatatgtgggcacatgtgtacatggaaaattcaagaatggcaaacagataatccagcagtatatttgaccaaagactcaacccccttcactagtgcatatcagagatgattcaaattttgcgtatttctaaattccaacttcttggaaaggcct

SEQ ID NO: 7973 - DNA, 1202 bp, Homo sapiens
atttaattaaaaataaattatcatttaaatgaaggaatctattttagtctcatgcctacaaaaataaacctgcattatgaagtgataataaaagttcattctatgaagacttattaaacacctcctgtgtgctaggcaatgttctaggaggtggagattcagaagtgaatgaaacagaatctagtagacatgaagtgctatgctgatgcttgagacacatttcttactttgccccacaaacgaagtggtagggatttctacctgggtggagttgggaagccaggtctgccatttgccgcagtactgctctcaccttactaagtgacctatgcatccttctgccagaatgtatgaagccccttggccacaaagctaagtagtttgcttaaagaagcctcacctttgctggtcagatgcttacctatgttctccttcctccatctcacagtggactgcatggaccccacatgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcggtaaatgcagggggagaagaagcatgggtagagggaggggatttccactgtgacatggtcaccaatcacgtgactgttcccaatcacgtagcaatgcattccccgtgcctctgagtgcttttcctctttctctgaactctagccttcaacacctctactcttagacaaagagaggattcaaaaattacatccttacatcattccttccatagtagtggccctgagattcaaaactaccccttaacaatggagcttataattacagatgtgtttcaccgaactctcatctcatgttaagacatcatccctggaggcaaggccatagggaaagtgtacctaggtaagctctgtaggggtgggccttataggataaatgtcccagccatcaaacccttcagtttcacccatttctcagaatgaagtccaaactcagtgtagtgtttagggttctttgggatctggcccccacctgcccttctagccaaatgctctgttagtcactaagctccatgagggtagcaaacatgtcttgttcacctctgcagccccagga

SEQ ID NO: 7974 - DNA, 1166 bp, Homo sapiens
atgattatgggctatttgtatttcttattcagtaaactgttcatatccaatgcctattttcctactgagttgttggactttggttattatttgtacaagttatttttgcgttaaggaaattaacattgtcataccaattgcagtttttcccccagattgttatttatctttcgaagcaaagaccaagacctcctgagactccccgatcctgcctactcccagttccaccagactgtgagccccttgagggcagggtctgaaccttgatcctctctgtccccagtctcctttgcagggctggcactacaagagcttccttttggggctacttgttgaactgaactgaatgcctgtgttcccccaccctgcccacctttcccttatggcttgggagtcccgtttctgcctccagcagaaaaagatgacttttctcattgctcaccacagccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggtagggttgctgcgttgtccgtgttgtgagtcctctgtgtctgcctctgagctgaagagccctccataacgtgcgtgcatcatgtgcctggctcacagctccatgctctggcgctccctccatccttccacactccacgccagctgtcaagctgccagtccacctgtgtcttcatcgcagttccttgtcactgagagttcgtgggaggctcaggaagggctcatggtgctcagcagaatcccatcccatgccttgagggaagcattaggggcttcacactgctggggtggccatctttgtgtggggtgagaggagctcttctgggcaaacctcatgggacagttgggcatctgtgggagtggggtatggggaggcaggtagatggggtgttgtaatggaaagattcttggactcttgtggtttaatagaaacaccagtttaagtggtctgtcatttactaaacgtgtgaccttgagcaagtcacttatttgcctgagcttcagtttccgcatccgcaataataacaataatcattagtgttcgtacag

SEQ ID NO: 7975 - DNA, 1182 bp, Homo sapiens
tggcctgtcccatgccataccctgtgctttcttgttcttagtccacagctttggtgatgagccatatcccttgcccactcctcccaccacgctccatcctgctgcagatcatcttggtttctgaccttggtgcctgactccctcacccagccttgccttatcttccacatgagactcttggaaccatcattttttgatacaatctcagcttccctttaagccataattttagcctttccttctgcttggttgcctcaagctgccttagtgaagtttgacctggggcctcctccgcatagcacgaaattggctggaattgcctgtgatctgggagccaacactgacggctactagctttgttgttcttaggagtccctttaagaagtcctggcccagattaaatgcaccccataaccgcttcctgctggcaagctctgtgactctccctggtggcagcacatactaacacaacagcaccttgcttctgaaagggaaagggaggaaaaggaaggctcagagccatggtaaattaagacagattgcattcccgaaactgggttgagacctgctgagtgtgcagagaggtacagcaaatgagagttttgtttttaatttgagacaacacgattttcaattccagtggaggcaacaacatgcatgatgacaaacttcctaccgaaagatgtttcagaagcatttttccctgtcagtaagctcagctttgtccaagaagagtggtttctgaggctgcttgaacttcatctgacccaggatgacttcaaggaagaaagagtataaccaacattgggaaaggagcttcctgcctatgggagcctagttccagtgccagatgtgtggagtccagggatgaatctggtttcaattttaggctgtgtcactagtcctagtgtgactttgacctagtcacttctctctgagcattatcatagtttccccatcagccgaaaaaggtcagtggaatctcagacagtgagataacttggaaggaggataggctttggagtcaaacttggaatcccaactcagctacttaggaattgagtgactttgtgcgaattactagatctcactgagatgaagaaacggagaaactcagtttcttcatctgcaacctgggaatgaataactgtctacctcctaaagttgtaataaggatggaag

SEQ ID NO: 7976 - DNA, 1077 bp, Homo sapiens
cctcagcctctggttcactaaagcctcatgctttgagcaccccctctgccacctgtgtgagtaatggttgaaaaactcaggagtacttagcctggaaattgggagactcgggcagtatgagtgagtttccatatgctcattcatttattcaacaaatatttattaagtgcctactgtgtaccaggcactgtcccacctaggtctgggagtagatggaatgcagttcctcattgtgtgatctgggatgcttcattgataggagaatgctttaaaatagggagaaaacactgatatctgaaagggagaaatgctaaaagcagcatctctgtgaatgcagctgggaagtatctgggatttccaagaccccatctatgttctttgtgccagctaaggggatgtccaccgtggcagacacaagcccctgcagatccaggctcctgcagacccaggcatgagcctggggaagcagccctgcctcagctctcagagttcacccaaaggaccccagatggctgaccttcaacatcttgttgattgggtgccaggacaagaactaattagtactggtaacaagcttgttcgtttttcagagagcacagagaagaaagtggagatggaaataatgttctggtctcaaactattttttttttttttaaacttagctacactgtattttctttagaccatattaagcattggagtcctttttaaaaaggtgagtcagggccatttttatcaagcatcagctgaattcccaacactctactatctgctttatataggttaacattgctacttttttaatgctcacaagaacactgtgaaggagggattttttttgtcatacccattttataagtgagaaactgagaccctgaaagccaaagctcaggctctggagccagcagacctctgtgtgtgacccagctctaacattttccatttgtgaaaccgtaggccaagctgcttcactttcctgagcctctgtgttctcatctgtaaaatagaatgatttcaaatatctgcatcataaggtgaaaagtgataaggatcacttaaccataatgcatgtgaag

SEQ ID NO: 7977 - DNA, 1279 bp, Homo sapiens
tgtaccaagtacctgtcattcctgaacgtattgactccacacatctccgcgagacagctgttgttatgtggagaaattaggctaattaatttgcccactacgatgatgacaacaatgatgacgatggtgataaaagcttatatttatatggcagagactattataaactccttatctgcattattcactcctcacaataaccctgtggggtaggtgctgttatgatccacattcttcagatgaggaaaatcaggcctagaaagataaaataacttgccccttagctggtaaatggcaggactggggttcaaatgtaggcagattgcctgcagaacctgtgcttttaaccactaggatggaagttggaaagcaagactgacatagtctaaacatccttgccctttcagccacacctggctgtcccatctcatactgatataaatagtattacaggtgagcatgtatggaatgttggccaagggtggcctctgtacttggttgacattactgcgtatttaattctcactgtctctgtcgaggttggtggacactgaagctcagagaggtcagctgatctgcccaggatcacaaatgctaactgtggctctgggccactttttaagctacgtggtttcacttgctggcttatttcattaaacatataaaataattcctggaggcttggtctgttgaatgagcagtgattcaacaaactgagtggctgctcttggcttctctgtggtgggagaccaatgagcacagtgatgagactgacccagtcctgccctggaggagtccctagtcttggggtgggactctggcgttggtgccttcctgccccgaatccccaagggccgcagcgaactcacatggtaggactttgcctctttcaaccccatgctggtttccttttgactaaagaaacagcagcctccacctgctttagtcagatttagatgtagcaagtgattatcacttattattgctattaatctgacacaaaggaggcttgaaactcttgatcctcagaaataaaagaccccaccaccctgccaaaagaaagatcaataactttgcaaattgttgctttttgaagccttcaaggaagaagttgtgttttttggtcaaagcaggccatttgaatgtcacatttgttatgtctctcttctttttcttttcttccaataatttgagtcaaaatgatgataaaactgctctatttttaggtagtttcagcaggttgttgacacattggattagcataagtcagttatttctg

SEQ ID NO: 7978 - DNA, 1185 bp, Homo sapiens
ggccaaagccagtgaggggtggccagaaaggggactcagagggtacacctacttgaccagcctcctgggcacagagcagggcagaaaggcagaagatggatggcggggccagggtgcagttggagaagccacagcacactcatgaagggaagggtctgtaggggcagagggagacccaggaggccacaggcagagcgtgcctgctcgcagcccctgggggctgtgtgcttcagggaagtaattaataccatatccaggaatctcatccctggacccataattacatgtacaggaattttttaaagggttgatggcagtggttttaatgtctcataaatattcttccaaggattctccccatagagaggagtggtttcatttctcaggcttgaagccagctctgagcctttgaagaagaggctcccagcctcttctcgggaaacaaatctcacggtagcaccccttccccagtgtcctcctccccctccctaccctccatcccttctccctgcttcactgaggactcaggtctccatgtttacaagatgctctggacttcataattgcttggattctgccacataggaggcttccttcaggaagtattccaggattgctgccagtagagttcctgaggctgatctctgcagggcatgggggattgcagatgctggtaaaaactttcttgagaactccatgtttgctcattttgactaaattctggactgagagtggcatgtacataagtaggaggctttcattccaccgaaagcgaagcctgcacaaggcagaggaaaagaaacacaagacagaaggaacaaaagagcatgtgtctgaagcccccaggttaaggaagggtgttcacagagaccaccacctctaatccccagagaaccctctggcacggccactgccaattccctcagttgatttggctcaggtgtggctggctgaaggctgcccggccagacgagttacatttgaatcttggccctccccctaatgagctgtgtgtccttgggcaactccctgtacctatctgatttgctattttctccttcggaaaattgtgttgtaattatgtctaagttgagataatttatgcaaaaatattctaccaccatatctggcacgtgccaaatgctccctaaatgtgacctagtttgaaaccccaccttggaatga

SEQ ID NO: 7979 - DNA, 1150 bp, Homo sapiens
tacttttgtttcttttctgttcacttctgggctgtgccccattaaccattcatgcacaaccctccaccaagctggcaaggcctcagcattcttcaagtggaagagagaatgcttgatttctgtccacatcctataaaatgcttatcagatgataatagctttccagggttagtgacagagacttagcatgacccaaaggcctggaggctcttcacttatgcatgatttggtgattttacatctcttagacaataaatttttggttgagaagtacttctactcagcggtctgattttttcttgagatcttctcaaacccacctcaaactggggaaatgtgttgtattttggagagggcttttaacatttaatgtgcataggtaccatctgagaacttattgaaatgcaagttctgattcagtgggtgggagcatgggcctcagctcctgcatttctgacaagcttccaggagatgttgatgccgccagtctaaggccacacttggcttagcagagctctaagaccttggtcttccttcctgcttctgctttctcccttctgtcttcttaggtccaggagcatcagatgcagactgtcattgagtgaatggaatctgtcagttttgtgcaaccgtttgtcagtattgttgtagcctcagtggaggcaattgtagtgtgaagtagacagagtaaatagtggccattatcatcatgccgtggaaagattccagttccacgtattatgttatactctccaggcttcttttatatcttcaagcacattaagcctcatggcaccttgtggaataggcagtgatttttattactaggataagtattactttgaaaattttataacctttattatgtttttgtttaatgtggttttcttctgattatgacaataatgcatataaacaacagaaaatttaggaaacctaagataacacagagaacaagaaaaagaacccataatcttgccatggagaggtagtttctcctaaccttttgattttctttccagtattgtttctatgtaaaatcctaattctcaccactaccctctcccaccataatttggagcacattacacacattgttttgcaaccttaatctatcacgatcgtttccccgttccattaatttttcctc

SEQ ID NO: 7980 - DNA, 1219 bp, Homo sapiens
agcagactggaaggtagtggggcggcgtgtgtgtgtgtgtgtgtgtgtgtgtgtggacacacacacgcaaccgaggaatacacaaccaactacttgggtgaagggcggggggttcacctagtgagtccttcttggcgggggggtcgggcgagttagctgcccgctgcccgccccttctctgcctgcccccgcctaggcgaggttggaaagtactggaaattcagctgcgtggtccttaactttggaaattggctccgctttcagggcaaaatgttaaggcgatttatgcacccgcgtccatgtggatgagtgtattactgctcagttgggtgcagagccctcaacagtaccgcgccaagcccccacccgatctctaactccctcccaccccctaaccgtggagagagggtttatagaaatgcagttatctgtaaaccatcgacgcagtgaaaggggcgcagggaggcagccagagttttgcctgaacctgcatactggcttggtgtttgtagcacacgagatcaccccgctgctttgtagaaggcggtggtggggcaagctcgggattccaatcgccggggtggggggtggggggaagagggtgcccatgtactgagctctgaggccgagtaaggagagagatctgctgagcggcatcgcgggcaattacataagctgcctcggtgattacccggaactgtgatgcgagctcccggttctcgaaagacaagcctgaaagtttgcctgcttggggagtgtaagtaccggggcgcccccaccccggcctgggtagctaggatacgcctcgcaccacggcgcccacttgtgcgatgggcgtcgggtgctgatgctgctgtccccaaagaaccggttaccgaggcagggactaagtgggggcatccggaattgatcgcagaggaggagtcagtcagaactgaggtttcattgggtcttcagagctccaagtcttccctcggaggtgttggaaggccttccagggaacgccgttttcagaaactgacttggtgtcctggggagccccaaagcccctcttttccgcccttcctgggcgcccctccttgtctttcaagccctgtgcccttcacgtgtttagaaacctgcccgcggtgcctggtcccccttggagatgcccaggcagcccagccatccaggcccacgctggcgaggggttagagggagtagaacgctggctctgccg

SEQ ID NO: 7981 - DNA, 1265 bp, Homo sapiens
aatactgtataatgactaatggatctcaacatgctggcctgacacctggccatagttgttatatagctagttcccatcacgatcatctagggtgcctttttaaaatgtagattctaagtcacacccctcacctacagaaatagaatctcctcaggtggattcaggaatctgtatttttagaattgattcagacagagttaaacaactagtgattgcaaacttctgaattaagcaaaaacagtagaaaacaggtggttggggcctcttggccagctgggttagacattctagatacacttaaagagtgtcactactcagagtatgtcccctgagtggtggcggcagcagcacctgggagcttgttagaaatgctgaatctcgctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaaaaaaaaaaaaaaaaaaaaaaaaaaaaaaaaaaagaaatgccgactctcaagccccaccccagacctactggatctggacctgcattttaacaaggactccagctgctttgtaggcacgttgaagattgaaaagcactagaacatgcttaacaacaaatcacaaggggatccaaccctggggtcaggtgggttgcaaattgctcattggccatttgttagacagttgacacatacgtacaactcagttggtactagaccaggcgcttatatacattatcttacttaatcatcctaaaaaccctacatggtaggccctgttatcctcattttttaggtgagaaatccaaggctcacagagttatagtaactcaccaaaggccattcagcttttaataagcagagctgggatttgaacctgaaattgtctctccaaagcacacgctcattccactgcagcatattgcttaaaatgaagagcaaatcaaaggcgcagccaaatttaggaaaac

SEQ ID NO: 7982 - DNA, 1133 bp, Homo sapiens
caaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaacttagtcttttttaattgttcagctcagaccagaaaatgccagctatattataggccaatgagtgtgctgagtttgggatagaaagctacaagatcactgatcttaaaatatgttagtctgctggataagacagataaacaggtaacttcaatacagtgcagaagatgcaatgatatgggtttgtaatgggcatgacaaacatttacgttgctatgagagcatggaagaaaagcagctaactcatcagtgagctgagggtaagaagaaacgttttaagaaaaaaagctatttagaagttgtatgtgaaactgttgctattttatttaatacgtatacactgaatgcctactctacatgccaagggccgtgcttagtgctggaaactgaagataaaaatcaagctccttccctcaaactcatgagctattggaataatcaggtaattagaatc

SEQ ID NO: 7983 - DNA, 1263 bp, Homo sapiens
tcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaat

SEQ ID NO: 7984 - DNA, 1245 bp, Homo sapiens
tacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaactttgtttgtacttctttatttcttgaaaagctttagaatgtgactttcttgttgtctttcatctgttttttgaaacatgaacatggtacttgctatgagccaggcactctgagacaggttagtcttttctgccatttattggagataggcatataaaacactgagttttattgagcacatagtatgtggcaggcactagcactttctacatgtattttctctggtattcacatctaataactacatggtagatggtgtccccactttacagatgaaa

SEQ ID NO: 7985 - DNA, 1298 bp, Homo sapiens
tcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatg

SEQ ID NO: 7986 - DNA, 1282 bp, Homo sapiens
caagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctggtaaggatccatctcttcccgtaacgctcatgctctgctgctttgtctactttaatgggcaacatctcagtttgtgtgtgtgtgatttttttttttttttctgttttggaaggtgggagggaaatctaatttgggccctgtccaccctggaaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattc

SEQ ID NO: 7987 - DNA, 2021 bp, Homo sapiens
tttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtctcttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacg

SEQ ID NO: 7988 - DNA, 1165 bp, Homo sapiens
ttacgtgttactggtatgcatgttttggtgttcctgtggcactgccgaaacgtaggctgtaaattagcagagggttttccctgtgataaactcaacactttttcccatcagggattttgtgggattatgtgggctctttcccaattgcactggtttcctctcttggggcttggaagaggcaatgtgccccactctgttgtgaaccctttccaaagtcaaacacttactctgaaagcagtgagtgtatattaagtcaagatttttctaattgctttaatcctgtagatcactaggtagaatatttcatctgaagtactggatttgaatccagaagttaagtttataattatagtgcctatccatggcaaggttgccagaccatttcatgacctgggtgtaatgtgaagtgtttagcaaaaagccaaattatctctgttcaattatcctagggcaactacactttccaatgcagtgtcttccctggcaagcactggtctatctctgaccaaagtggatgaaagggaaaagcaggcagcattagaggaagaacaggcacgtttgaaagctttaaaggtaagtttgtgcattctccttatttcgaaaaatgagtacaggtgttcattaggtaaatggggcctctgcacagacttagagtcttaaatgtatagctacctaatgggctgaaactcagtctaacttttcgtcctgacatagaattaggtaaaacagaatatctgctatcagaacaaattagaaaatgcttttttcagaggctgtacaaagaaatctggtttctggaatccttatggtagttccctttcttaacaggaacagcgcctaaaagaacttgcaaagaaacctcatacctctttaacaactgcagcctctcctgtatccacctcagcaggagggataatgactgcaccagccattgacatattttctacccctagttcttctaacaggtaggagtagaagttaaggttacctttgaatatgtaggttcaaagacttctaatagaaattttgcagaacttttcaggtttacttttatttatgcttttataatctattcacacaaagaggtggcgataaatggtgatattggtataatacctaaagataaagtgatgagtttatattttacgtatttacgaaatggaag

SEQ ID NO: 7989 - DNA, 1125 bp, Homo sapiens
tatataactgtaatacaatatcaaatccagaaaattgacactggtacaatgtgtgtgtttagttttatgtcattttatcacgtgaattttgtcatttcaagaatggtacagtttgggaccttttaagattgtttttttccactcaaacccttgagatccatccaggttgttgcctgtatcagtagttctccttttttattgctgagtagtattccatggtatggattaccatagtttatgtaactatctatggtaggaggttttggtcatttccagttctgggctattgcaaataaagctgctaatcagcagttgtgtccaggtttttgtgtggacttaagttttcatttctctgggtaaatgcctaggagggcaattgctgggttgtggttaagtttgtttagttttttaagaaactgccaaactattttccagagtggccgtgccattttacattcccaccagcaatgtatgagagatccagtgtctccgaatcttcgccagcatttggtattgtcattattttttattttagctgttctgataggtgtgtagtgatatctcatcgtggtcttaatttgcatttccctgatggctagtgatgttgaacatctttttcatgtgcttatttaccattcgtatatcctttttggtgatgtcttttcatatcttttgctcattttctaattggattggttttttgttgtgttttttttttttttttaactgttgagttttgagagtttgaatatattctaaatatgaatcctgtatcagatacatagtttgcaaatattttctttcagtctgtagcttgtcatttcatcctctttaatagggtctttcacagagcaaatgtttgtagtttttattaaatccagtatattgattttttaaaattattttatggattatgcttttgatgttttgcctgagaactccttaccaagctatagaccttaaagattttctcctgtgttctcttgtaaaagttttatactgctatgttttacattaaatgtgtaatccattttgagttgatttccttatgaaggtgcgaggtttaggtggaagttcatttttctcttatagatactcagttgttccatcagcatttgttggaag

SEQ ID NO: 7990 - DNA, 1197 bp, Homo sapiens
tgcagtgcttactttaaattaagttggcagttaggtatcaatggtggaaattaggtgtttatgttccataacataaacattatcataacattactaagacttaatgttttagtaattagattgtcagtctacctatgtaactgtttcctagagaaaaatcaggatagaagacagataaaatactagttacctaaaaatttaaataaatctattgttaggattttctggtaacaaattacttgggtatttatttctgtaagaaaagtttggaaggctttccacagcatttgctgtatttcttgaaggcagaagaaaaagtaagtaccatgctaacaatgtaaatttgtaaggcccttcataaatttgcacaatgccttcttacttgctcaagacacttgtgatgtattaattgctcttattcatatttacgaatcaggagtataagacccaaagaaatagccaagagcacagaggctggaactgagctttttctgaaacaagaaagctgtctgaggattcctccaatgctttagaacctggtaattttattaatttgatgtttttaaaaatatgtttatacagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatactt

SEQ ID NO: 7991 - DNA, 1191 bp, Homo sapiens
tgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgttaggttgtgtgtgacttggcatatttctgaaagtatatgacagccactaggaagcatatacacccagcagtgagaaatagaggattcagtttgtagggcagattgggaactgctttctgagggcctctttcttttttgctggggctctttttcccctgtgggatttctcctgcgtcagcaaacccccacagtctaaggtcaacagaattgattgctaatatggtcatcagtaacactcaagtaggtcacatgatgctttggatataactatagttctcaagttgttatcccaatgacacctctttttttt

SEQ ID NO: 7992 - DNA, 1129 bp, Homo sapiens
acgatgacttggtcttgaaatatctgttcagtgctaagctgcacaacttcaggggacatcatccatattgtaatagattgtgatggacatattctgagaggcacaatgtggatggtacccctggagttctgcaaggaagctgccctgaaaaaagaaaaggaaaagaggctttgaccctttatctttgaggtcctaggttactggtcctcaaatggattgatatggtactcactgagaattatcagcaggaaagaagaacaagggccccagagaggcacttgccataagggaagggctgtctgcagagcactgggctcagcaaagctttctgactgaggctagatgccattgggaaacaaggatggacctgaatcactgaagggccactgtaaccttaaaatctttctgggctctccccagcaccagtcagaaacaccaaggtagatctagaagtctcttttcctctctatttcaccagctgcttttcctcgagggtccaggaagttgagactgatgttttaatttcacttcaaatataccatcctgtactgtgtatgctcagcaagtgttaatgactgaccggctagctggttgagtgaaaagttttaatattgaaagaattggagtcattcattattatttgattccagacatgagacagagtggcaatttgaggaaaatagtcccatgtgattttgtgtgtgtgatttttattattaaaaaactaaatctatcattacattaagaagctttccttttataatcttttaaccatataaacaagaatattctcagccctaccttctctggcctcaatgtggctgtgaagatcttgggcctgggtcagtcaacactaggtctgagtcatgttttgcaacctatttgttctgtgatctttagcaactcacttaagttccaagcgtgtttctggtgtataaaaggggacaacaattgtacatggttcataaaattagatgttatgtgtcagacactaaacctgacacaaagtaagcacttaacaaatgttagctgtcactattatttccttcatcaccaaactccactctgcatccttttattattattatttttttttttgagacggagcctcactctgttacccaggctg

SEQ ID NO: 7993 - DNA, 1111 bp, Homo sapiens
tccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcatttcggtttcagacttcaaagttgattaataaatttaatcttaactttttattcactggaatcaaaacgatggttggtactgtgtttactgtttaaaatgaagtactaaagccctgagaactgcacctcattttctttatccagaaat

SEQ ID NO: 7994 - DNA, 1149 bp, Homo sapiens
ctagaatgaaaagtatgaggtaaataaaatattttcctggttgacatttacatttggaaataattagaaaattgttttcaatatgtaaaatagcaagaaatcaactttgttaatactttaaaccatgctcataaagcatacttcttgtcatgttctgcctaattttacacctgattttccattttctctgctcttgttctagaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatata

SEQ ID NO: 7995 - DNA, 1112 bp, Homo sapiens
cctgcctcagcttcccaagtagctgggactacaggcgcccgccactacgcccggctaattttttgtattttttttttttagtagagacggggtttcaccgttttagccgggatggtctcgatctcctgacctcgtgatccgcccgcctcggcctcccaaagtgctgggattacaggcgtgagccaccgcgcccggccaagtaaactcttaaaagctcatttatgagggctggtgtcccttttaggatatatgggtatgtactctgtaaattttgtttttagcagtcaggtacttttaaattatctatttgaacattaacagggtttttttttgttgttcatcttttatggcaaattattttgacttggcattcatatttgttatttactttgttttcaccagtataattccatggcctcagttttgaaatgcaagctattaagcccagcttgtttttaggttttgttaatagggttttctgtttcatttgttttgattgtttgataggttttttgttgttgttgttaattatccctgactgcttccctactgcccaggtatcttaacaacttaatctggtggtgttggatggcttgccttcttcagttacgtatatgcctatggctttatacatatggcactatctctaaaataccaggcttgcagaggttttcttctgcatgttctttaactttttaacagaattcttcattgtgaagattatctttaagaacagtttttctgaagaccatgttttcactaaaaactcaatgacttttcttagtttttccgtttagtgggtcacctttaatgtccattgaaaagaaatataacttccagccttaaacatttttatgtttcttaaagattatgtgtcaaaataattcaatttgccattcctttttcattaggcagagatgctgcttaaatgtttaaattattttttaaaaactttgctaataaaagtaaaatcagtgattgagtctggaaaagggaaacctccctgaacttgaggcactttcccctcgttcagtaaagaggttagatggatgtattaatatttttaaacaccctgatccttttcttcattttgcttatttcattttgcagtt

SEQ ID NO: 7996 - DNA, 1135 bp, Homo sapiens
cttattagccagattgtgtcctctatcactgcttccctgagatttgatggagccctgaatgttgacctgacagaattccagaccaacctggtaccctactcccacatccacttccctctggcgacatatgcccctgtcatttctgctgagaaagcctaccatgaacagctttctgtagcagagatcaccaatgcttcctttgagccagccaaccagatggtgaaatgtgaccctcgccatggtaaatacatggcttgctgcctattgtgccatggtgatgtggttcccaaagatgccaatgctgccattgccaccatcaagaccaagcgtagcatccagtttgtagattggtgccccactggcttcaaggttggcatcaactaccagtctcccactgtggtgcctggtggagacctggccatggtacagagtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagacatggctgcccttgagaaggattatgaggaggttggtgtggattctgttgaaggagagggtgaggaagaaagagaggaatactaatccattccttttggccctgcagcatgtcgtgctcccagaatttcagcttcagcttagctgacagacattaaagctttctggttagattttcatttggtgatcatgtcttttccatgtgtacctgtaatgtttttccatcatgtctcaaagtacagtcattaacataaaaaaaaaagtttatgttatattttagatcatttgttggcatttcaacaatgttcacagcatcttcactaagagtcgattttgtctcaagaaaccacttttttttcccatccagaggaagaagcttctcatccattcaagtttcattatgagattgcagcaattcagtcacatcttcaggctccacttctaattgtagttcacttgctatttccacatctgcagttacttcctctaataatgtcttgaatactcaaagtcatcaacttcttcaaactcctgttatggttgacattttgaccttctct

SEQ ID NO: 7997 - DNA, 1233 bp, Homo sapiens
ggatcaaggggacactgtgtgtcacatcaattatgaacatgttataaaaggaaattgaaaatgaaattaaaatggaatcagtggagaaggaagaaggagatatattaggacaatcattccaaaatcaatcccaaaatcaaacagacacaacaaagtccaaagtttcaaaaacatcagattggtatgcattgactcctatggatttttttttcagactttcagcccctttaattaggtcagaatggcaggcaaggggtggggaaggtggtgcttcttgagctccactcagcaactggtcagttctcatcctctggcaactggatcgtgctggggttgaagcagttggattccatgatgggaaggtctttggcctctcggtatttcacaagcatctcagctctgcagtgggcccactctcgcatcctgtaatcaggcagataggccacaaaggtgctgccaaggaccgggacaatggagacgccaaagaagaagacaactcacatgttccagatgtccaaaatggggtccttgtcatagcaatgggagtctgggttcttctcatagaagtttttgtcctcaggatctgggtcctcctgccaatgtacggtcagttccgggggctgttttcccaccacagcagacagggcgaccacagtcctggagaagctggattcccagcggaggtgggtggccaagagcctttgcatcaccactgccgccaaaagactgggagcgctcaaacttaacagcccaactgccatgacagatagtcctacagggtctccaactcctatagactctatgtggattttataatacagatgataaagatttgatgcctttccatgaactgtaaaggacaaaattatacaaataatttatctgcttcatgtttacttagtggagagatcaatattatgatggcctagaacagaactgaattttttggccatttttaataaaaccaaataaccagaaggtatttgattaacaaaatcaaataatctgaaactatcagataatttttcttgatggtctggtagtgaaatgttgaatccaagtaaactcgagtaggagaagtagagtcctaggctatatgactttcatctaagattctgtgagaggatggcaaataagcatgttctttggtcttccattaaaacccttttaaaatataatagtattataaccacttacttttggtctggggcttggaccctcattttatcgttg

SEQ ID NO: 7998 - DNA, 1286 bp, Homo sapiens
tttaaggtatatgctcgtaacaggtataaatgaagttgtatcacaaatgcaggttgccacgaaaaccagacagcaatttataggaaggagaatttttctcactttgaaatggctttagggtccttttctgattcttattaacacagttgtctagtttttattaaactttcttgcctagtttctccaaacctataagccctcagatttgcttggttgtatattcaggtaaaactgacaaggtgcaaggttatgtaagctaaaggcagatgcctgcattgaaggccagagctaatggaaaaaccttttatatggtagcaaattattttagttttgtagattagatgacccatccaatgacattttaaatttaagcgtaaagattggctggcttgcatatttccagtgttgtgttggttctagtgaacaataactgactattgagtctccagaaaggtagtggctcctccctgccccagtcttgtaagaggttgcatcctacaaggaagcactgacttagctacatgggaatatactactcagctatatgggcctggtgattatttattcaaaaggtaacatttattgagtagccagtagacataaaagtattttatgggatatttgtggtagactccaagataaacaaaataaatcatgcccaggggatattgtaatccagtagggaagacaggcaagttaaccaataataacaatcaaggcacaatgaaatgagtgttcaggagaaacataaggggagctatatctgggcacagatgaagatgtaactaatattctgataagaggaaaaaggaaactgcttaaaggaagaactagcatttgaactcagccaggattctcagtggcttaaacaggacactgcaagttataggaacagcatgagcagagagcatagcgcatccaggtaatgtcatatacaaaagtggagggaaaactactttaggccagattgtggagtgtcttgaatgtcccaatgaaaatccctggatgctttttgagtaggagagggaaatgatccaacctgtatctgagaactggctggccatagccaggaagctaaaagatgaactgccttaataaatataggtagctttggccagcacggtggctcacatctgtaatccccgcactttgggaggccgaggtgggtggatcacaaagtcaggagatcaagaccatcctggttaacacagtgaaaccccgtctccactaaaaatacaaaaaaattagccaggcatggtggcgggcacctgtagtcccagctactt

SEQ ID NO: 7999 - DNA, 1141 bp, Homo sapiens
tttcagataatatttctagtctatgtatgttatttaatttttacactttggcccattgtttattttccttaaggaattcatcaaatgcaatgaaatttgaataaaattgatcatagcaataaataatttttaaattcagcacaaactcatcttgagtatattatcaatcaggcttcctttagcaataagaatggtgaatcaacatccagtactaaattcaataaatgatgaatactttaaatacaagaaaaagttgaattgcagaaaagaagaggggctaaaaaggaagaaagttttaattctcaacaagaaacactatttagatggaaagcttaaatgtattcttattaagggtatttgatgatgcattttatttgcaaaaataaccagtgggtaattttttctctgaaaatttagctttaataagtcgtaaaatttcctaaagattttggagacgatatttcgattataccagctcttgcttttattttgggagcctggagaaatgagagtgattgcacctgtcaaattttgtatctcatcacttttggatcatcacactgtgactaaaatgacttcagcattttgttggccaccacagtgaagaactattccctgaaagttaatcagttgcctgagagacttttctgctactgaggggaaagaaaggaaagctttatttacctctaatgagctccgttccaagtcagttaatcactgttcccttacacccaagagtttcatcagtatcagagtcaacttgtcaaaacactggttctcagacgtttttttcagagggacttcttttccccacatggccagatttctttacaattaagaaaataagagctacagcgtattcttggttaaaaaccagtttagatgatgttaccaaatgaaaacaagtctgtattagcaaatgccacattatatttagtcgtattctcactaaattctccgttattaaaatgatttctgcatcttgcctggaaaatgcacttacatatttacaagcgttgtatgtcaatgtgcatgttttgaatttcctaacagtgtctaatcttagtagtttcatagtagttatgtaaaatctctttaactgcaaaatactataaaatattacttgaaatattaaagtatt

SEQ ID NO: 8000 - DNA, 1112 bp, Homo sapiens
tgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtg

SEQ ID NO: 8001 - DNA, 1112 bp, Homo sapiens; identical to SEQ ID NO: 8000

SEQ ID NO: 8002 - DNA, 1112 bp, Homo sapiens; identical to SEQ ID NO: 8000

SEQ ID NO: 8003 - DNA, 1161 bp, Homo sapiens
agtacattatctcctttaaccctcagagcaacattactagtgcatttgttaacctcctcctccacttttattctggataaaaatactcttctgtagctgtaagtgagagtctgggaactgaaccatgccctttagaccccatagtttttgcccataccccctgagttgtcccaccccttgcctgtaagaggcgtatgcttacacatatttaggatttaccagatgccaggcatcactctaaaaatttccaaatattaactcatttaattaactaggccttctgttaaatattaaggggaaaagcattttattattccttttcttcctcctcttttaaacggattttatttttgactactgacgttgtaggtaaagaagtatgggtgtttgaaatttttagtgtgacattgttgaatgtgtatctgcctttaatatttgatggtcttgatgagtgcctaagttatttttgtttcctttattttttagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtagggtttgcttttggca

SEQ ID NO: 8004 - DNA, 1110 bp, Homo sapiens
tgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcgtatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttga

SEQ ID NO: 8005 - DNA, 1172 bp, Homo sapiens
ttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacacaaaaggcatgaattcattttttacctgtgtatgtctttcttggatccagaacattattcatccagcacgcacttagttatttaacatctactcactcagtctctccagcagcaattttgcattgtctatctagcccccctgtgattgttcccaaagttttgtcttctcaacaccacaacactccaggggaagggaactaaaccagttgctctttacttcagttaaatttttaagatgtccaccaaggcttatctctttcaagccatcctacgtaacccagtcaccctagactaagtaataatgttatttaatcaaagattaaatatttat

SEQ ID NO: 8006 - DNA, 1147 bp, Homo sapiens
tgtgaaaataactcagcattcttccagaaaaatcatcttctaccagagaacctgttcatcttggttcttttttcttagaaaatagagaaattgactttagctgaaagctcaccctgtttgaggctttagagtttttatgcttccctatcccctacctacccccggcccccaccgccaatgctagaccctctaaatatggtccccagccgacttcggtccaggaatgtggccacggtcattctaactgtacctcgctgaagtcccagtctcccaaggtgccagagaaggtgtactcttttgacatatgacaaaagacctgtcttaacaatttggagattatcaacatttgaagactcgtactgtgcttcatcctgtatccctaaattacaattaaagtctttgggacagcctgagataaatgtttcaagtttttctagccaagtggctttttatggagactgttttgttttgttttacagtattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggtgagccccacacctctgtcagaccatgattggaaaagcaagaccagacagcttctctgccactcatgggacacggaaatgtccctgaatagttcctggtctcagtttactcatctgtgaagtggggagggaaatcagtcatacttcagttatagatatgtggaagcattgtgtaaattctaaagactgcaccactggagtagctcttagccatgggttgactcagatcagaattatctattattgttgtaagttgaggtgacccttataacacaaaaggctctcatagaaaagcctagagacatcacgcctctgaacttggctctgctctagaccagttgtatgacggctccacctctgcttccacgtctggaaagggaggacagtgtctgcctgctttaccccatggggagtgggagggaataatgggataatgggggg

SEQ ID NO: 8007 - DNA, 2255 bp, Homo sapiens
gtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggc

SEQ ID NO: 8008 - DNA, 2703 bp, Homo sapiens
ttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgtaccccacttaatgttttgcttcagaggccctcggctccccccttgtgggcctcacgctgacaccaacacgcagctcttgactctgaggaggaaatgaatcatccagaccatcgcagcttgcagcccgcccactcctggctcctccagacaaataaggagaaaggaaacgcagggagactgtgtgcctgggtgtccactttgatcacatgtgagtgtccacttttgaggttccttagttcagagcctgcaaatgatcactgtaaactggctctgtctcaggaattcacccaggcagcctggagtcagccatggctctctgagcctgaggatggaaatgggagatgggagctgttttgtcagtgtcttgggg

SEQ ID NO: 8009 - DNA, 1084 bp, Homo sapiens
tgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaatcatttgcctactttgtttatactggagtagcattctcgc

SEQ ID NO: 8010 - DNA, 1062 bp, Homo sapiens
ggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcac

SEQ ID NO: 8011 - DNA, 2203 bp, Homo sapiens
gccataaagaaatttttttcaaatttctttattgcacaggcttttttcagttttacctttctgggattgaacaatgttcctttcataatgccaaagcattcccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaaggtttaagtaactaaaatggccacttagtttgtgtttatttttttccctggaaatgtaagtagttggagtttaggctatggaaatattagtgcctttaatagatctctttccttgcaaagtttctttttagctcagcattgatctatcttatcaataggaaaataagttgacttggaactataaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagc

SEQ ID NO: 8012 - DNA, 2169 bp, Homo sapiens
attgtcttgttaattatttgttgtatttggaaaagtaccagtttcaggagcacctacacagcaggttattctttggaaatactcaggggcactgggaaagccagtgaaaagattagtggtgtccacagtcccggtatttaatttcactgatgggttggaaaggtgccattggttccaacagctgaaaaaacatacactgcaacatttagggaatgatttgacctggctttggtcaggattgcctagttgaatattttatgttttgctcttgcaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaagtttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaacgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaacccta

SEQ ID NO: 8013 - DNA, 1165 bp, Homo sapiens
cagttcctgttctcttatcacagttctattcctccacactcccttcctgctaggcacgggaatttgaaagggcagggaaaaatcggtgaaagtttgtcttctacttgggtaatccaacaccaccgcatccagtagtatataattctttttgcatgtatatcagatcctccccaatccctctcccatacctctttctcacttttctctcattatccggtcctcttgttttccttgacccccacattcctgtctaaatcatcctcctggcctcaggtccttatcgccttcctgagaccctcatgtttagtgttccctcattcctcttacacctaggatttctcctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccaggtaaccaggacgcccagggccccgcccagcgtccgaaggggatggagaggggccggggacctgctggattgttgccccaattcgcggattctggtttctgaaggctacgccggaattccttccccgggacttgggaaccacttctgcctccctccctggggcgtggaggctgaggaaaaggaggttaaaactcgctgcttctttatcgattcctctacctttcatattccgatctcgttttctccccgatggaggtggtcccagttaattactttctcctgtctttcattccctctcaaaccttttttaagacagttccccccgcccccattcttttccccacatttcctgtctttctctgtcactttttccaaaaccatcctaaagtcagtctttcctcctc

SEQ ID NO: 8014 - DNA, 1580 bp, Homo sapiens
aaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtcgaggtccttggtgaccttagtagtaataacagcattgctgacaccctaattgccctctgctggaacagaaggtagttttccagtgtaccagtcccttagtctatacagcacccttggtttaagcacacttgccatcatctggtatcctgctagactagaatctcttaaaagcaaattggttttctttcaaagaccaacttgactccaaagagagattcagaatcctacttctcctgctgctgcataaagaatctcaaccttcattttatttgaacacggaccaaagtgttcctgcttctgagttgtctgtaagctaattctgcagatgttccattcagatttaaagcttttttactgcataggatgtggataggaagcctaactattgtatctgatggcaaggcatatgttgcagccacagtactggctatggtccctttgctgaaacaagctacagaagcactgattcaagttgtgcttgtgcttgaacttttaatcttctagatttgtgaggatggctctttttccttcataatggattacaatgtaagcaagtcatggccatatactggagacgggctaaagctgcttttcccttaaagtaagtttcctacagataaggtatttatgagcactgagaaagtcaggacatgtactctaaatcacacagaatgttaattccacaggaaggcaatgccagacattgaaagaggatcacattcaacttttaatagtagttcaataacaaaaccttagcttttcaggaacaatgtgaagatacattagaattgccacatccatatcttcaaaacacgcaacctctgcaccctaataactgcttacggtataatcagtatgatgatgagattgagggggtctaaatttaagttccttatctcctgagttatgtgaaaatatccctcagtacaaaacatttgtgtgtttcacagatgactctcttgttttgccgtaatgctaccaagtttatggaaactagtcaactgaaggatttttctgttgtgttatgtgtaaatgtctgaacagtaaaatcatctgtgtattcctgtaacattcacgaagtatgaggaagtgggtttctccttgtttgatgtgagtggttttgcttgttgcatgggttccctgtgctttgtaacttgcatgaacacaaccaggtttctcaacaatgatttgtctgctgactcttttcagagatagtgaaggaaaaaaaatgtattaaaaccccaaattatctaggtttccaagtaggaaaaataaagatacatatgacttttattattattcgatgataa

SEQ ID NO: 8015 - DNA, 1204 bp, Homo sapiens
gccgcggccgccagctctggtcaggggaggggggttgcgggaactctagctggggtgggggtcccgaggcgaagtggaactggagtcgtccactccgccgcggtgaccagctccccactcctcccagagtccggggctgagatttgtttttcccttctgagtttctctctgcggttgcagccccggggggcgtgctttccctccttcttcctttctttcttcccggggttcccgagaggttggcgggagtggaggaggggtggggaggaaggaagggggtggggaaaagtcgggcctgggccgcggtgggcttgcacaatgcgcgcgcctccgcgcgctccgcaccttcgctcccgccgggccgggctgggaaagggggaggggggcctctggcatttgtgtgtgggtgtgttgccagcggcggccgagtttgtgaagttgagccctgggcccctttcctttgcggcctctcggtccacttcagtctcctgggggagtcaaataattgttctcttgttttccagtgttgattagaggtgggggtagaaccggtccatttagttttttgctctttctttccttcccccctcccgtttcccctccccctcccgtaagcatttattttcctcgcggctcaggcgatttcggaatacaggtttcgggcttcccctgcccagactttcctggaagttgtttatggagttctttcacccctgctcttcccttgtgtgttggaacttgggccggcttgctcttatcaaacttagtaggtcgcgtgttggtttcccagttgtagactattatttacagtcggctgaaacgcttttgaattagccacatctgtacgttgcgcaggaactgagttgcgctttacagtaccgaggttttaacacaagcctttgataatacactgcaggttgactcataggccaagtcctgcctagttcaactgtgattaaaagttaatgtttgggaagcgatgactaattctaggatcgccattgctttttaattcttattgcggatatgaacatggctgctattccacatacacaatgttcgattattgtgccaacttgattcagcatagaagtgaaactgtttataatgagtgttaacattccaataggtcccagtggatttgttttgtgtagggttctctctttttctttcttttttatttcttcttctttttttttttttt

SEQ ID NO: 8016 - DNA, 3651 bp, Homo sapiens
ttattggatatctgaacaatgttgaagcaaaagtaaacttggcattgttattttgttatctgtgagttgtttgacctgatataaattctaggtatcagtttaggtcagtcaggagcgcttttctttccctgtgcatttctctgtgctcatatgatacagccctgatgttagcttttcaaaaaggactttgttatctctgtgtgtttccactaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgc

SEQ ID NO: 8017 - DNA, 1181 bp, Homo sapiens
agaagatgtttcaggtaaaacaaagatttaaaaccaacatgaactattaccctttttttttaatgaagtggaaacaatttcactaaagttattttttgttattaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaagattgtgttaccagaatattttttctttcctgatttaaaaagtaattttcatgtgtcttccttgtactcaaatgccagctattaagtaaaaaattgcattcatgagaaattattaagtgttgttaaaataatgttatctgtgaaatttctttagatgacagtgtcttgttgctttgtatgttatagatacaatgttggatgaaaaatgaatccaacattaatttcagaaaactcttaaattagataaataggcattattttcagacagtagtgtaattgctttgttgcataggtgttgatggggtgaggaggcatacaggcaatgaatggttagtacctcctttctgggtccagtcatatttgacctttcttagatctcactctgtggcagacttct

SEQ ID NO: 8018 - DNA, 2544 bp, Homo sapiens
gagtcctgaagtaagtattagcctctgtaccctcttttaatcttttcaattctgatgtgggagattattgttcaggaactgttaacacattccaagattttcaagcttatttaaaaatagtacataacaagtcattctgcttttctctttacatcgttaatacttttcttcccacctaaatataattacctaggttatatgtattacagacatcaagtaattcagtgtaaatgatattcaaaattcaaattaagtatttttccccaaacgacgcagaaagcttttaagaaatatttagacaaattgccacaaagtagaagtcaatactgaaaattgcttttctctttgctcttagtttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacgtagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaata

SEQ ID NO: 8019 - DNA, 1244 bp, Homo sapiens
aggggccaactcagaccctgagaataagggctaccatcccactcctccctcagaccccggagctcacccacctgcaactgcagtctccgaagtctccaccccagtctccctgcctccagaggactggttgcgattggcctgcaccgctgtcccgttaactcttccgcaagtgtgagtggcgtaactgtcgggctcttggccttggtcccgcccttcgctcgcctccgaagcctcgcctacttgacgtcatacaatgccgcaaagcgcagggctgatctccgtctccgcccccagctgctttctccgagaggaggtggctgagtcgggggcgggctgggagggctgtcggtgggccagtctgcgtagcgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggtactacaggtcttttttggtatttagagcctaggaagcagatcttgggggaggcgggccgggctgtggagacccgacactcccgcgctggccgcgaccctctcgctgtggagcctgtggccggcccgggcgacagcagccggcgctgcggagttgtgggcgacgcacggcctggtttccacggcctttgtaaccgccttggaggccgcgatggctgtaaacattatctctttccccttgttatttcaaatggagaccctcctaaaccatgaaataagtgtagggaaggccgacaaaattgggtttttctgtaatgaatgtttttatgtctttatctttaaatgttatttttttttgtttgtgtgcgttcatagcctatgcttattctgcctgttaaatatcccatcattctccaaggactccctgcacgtggtaggccctagaaattattgacagtatgatttagtttgtagccctgcgctccccgggattgaagccaatgaaattgaagccagagaggataccttcctcactagatgccatgggaaacagtattttacgtagatttatttattttagctatgtattttg

SEQ ID NO: 8020 - DNA, 1194 bp, Homo sapiens
tagtgtccaaacagtgcttgaagtaaatgggtgattgcttgagaattttatggtttttatgcatatggtattacattataatgacatttcattttaagaaaatttaacctatatgtaatgctcagttagaaagtacttacttaaagctaaaacaaatcattaccattgataaataatattttctgtcataaaggaactaatacacatgaggtcctatataacaaacactgataatatatactacatgccagaagacattacttcaagctctaagttagttaatttaatgtacataacatccctatgaggaaggtattgttatcatcatcgcaggttacatacgaggggatacaggcacggagagcttaaatgatttgccctaagatcatatggatggtttgttttcatgctgtaagggtttttttttaaaaaggttatagctatatagccataatgtagtatagcattgaaactccctatcttttggacctgtagattctatgaaaaatttttgtccaccaaattctaagagaaaatgtctttctgtatcttaggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggtaagaaatttgttagaattgttaaaactaagaatttctattttttatgcatgtatgtgtgattaatttgggtaagctagtcactgaatttggacgcaactgaatccagtcctgctgctctgaaagtgaaatcagggctactatgagagcatgtaacatttatactaatacttgaaagaagttgaaagatgagtcattgtgagttcagtacgggaaaggaaaagaggctctgacaaggagctttgcatgtatgaacagccaaacgcagccactttggctgggccataatgagggtatttaagagagattccagatcaggctggtagatcctacaaggtattgatcaagttaaatattttggtttcttactgtattttgtttctgtcactggcagttcctggttgctagtgagagaagccaacacacacagccaaaaaaccccccaaaacagtattataggttactagagtgattcagt

SEQ ID NO: 8021 - DNA, 1284 bp, Homo sapiens
taacaacttacacgtgaatgatcattaaaatatgtttaaaaatagcaccaaatgagtgggacactaaaggaagaggttttaggaaataatagaaacacatggttgtagtagataaaagcactgtggtttggggttgtgagtctgataaatcacttttgttaatgactccatctgaagcagtggattataaaactcagtgtgtaattttcggtgggagggagctggcaaaatctgaactgagtgattaagccccagtcaaatggactctggttcacatcagggctttcctcccaggaagtggaaggagaaatccaattgtattgactaaacaaacatggcagggattattgtctaaggctgtatgcatatgtaattgtccagtcttcactccaggtgccctgggtggtagactatttccagttcccagtcactaggggaatgaggctcttatttcctgatatcattaggattgggttagcatttggatgatctgtaggccttcttctgtgactgtagctaagcaaaatgtctgcaaagtaataccacacgattagtattccaaccggttgtctgattgctgcatatttgtatgtcttatttaagttgtaagcttctgatagatacactataatacaggcactcactaaaagctgtgtatgtatataatttttcggtttgaagacagcactcactaaaagctatatatgtgtgtatatatatgtatgtatacatgtaatttttcctttgaagacagtattctttgttcgctgtgttaatttgatggtacagagggtttgaggctttctatgaattctgtgactggctggagagggaaagaaaaatctaggaatcatccaaaaaaaaagattcctgagaatgtagagtggttgtaaagtaggagaccaagacaggaccttgaagaatgcctagttgttacaaataatctttgtcttataagtgaatggtcatgattggaaaaattagttgaattagtttttacttctttgtatgtattgttcatatatctttacctttcttgttatttacaccagtattattttttagaacatgccatttgtaatcttaataaatgtatatgtataaaatttaaacaatatagacagaagagtataaaacaagaatatgaagcataggtgagtataaaatgaaaaagtaaatctccctttcatgtcacttccaaccctaatcctatttgccaggttaacagtgttggtagtgtctttccaaattttttagtgtatttgaaaatgtgtaatatatata

SEQ ID NO: 8022 - DNA, 1101 bp, Homo sapiens
ctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaatacatcaactgtgtggtttctttgattaaccatttccccttgtggattttttttccagtaaagccgtccttcaaaacccttgtggatttttttttcttcttttttttttgtttgagtcttgtcctgtcgcccaggctggagtgcagtggtgccatctcagctcactgcaacctctgcctcctgggttcagcaattctcctacctggactacaggtatgcaccaccatgcccagctaatttttgtatttttagtagggtatcaccatgttggccaggctggtctcgaactgacctcaagtgatccacccacctcagcctcccaaagtgctgggattacaggcatgagccaccacgcctggcctccttgtggattttgaatgacttgacatattcagtatttcttcatattcaatttttcagagtcgtatcctctgtggggtgaggcaagcctgtctatttggggactatgc

SEQ ID NO: 8023 - DNA, 1097 bp, Homo sapiens
agcctgggaggtggaggttgcagtgagccgagattgtgccactgcactccagcctgggccacagagcgagaccctgtcttaaaaagaaagaaagaaagaaagaaagaaaataaaaagattatgagagggtaatcctcgaagcacagttggcaaaagccagcagcaaagatgtgtatgtgaggggcacaattcactgcctgttcttcccttctagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcct

SEQ ID NO: 8024 - DNA, 1361 bp, Homo sapiens
atataaaactttgaggtctatgtcctctgtgtgctgtagtgaatcccaaagtacctcctgaggagggggtaggccctgcccaagggtgctccctttgcctgcctttatgcccttctatgccaactttcaaatgaggttgtcaatcctctctccagcccagcttactgttaaaatttaggaccctgccagtcgcagtggctcccgcctgtaatcccaacactttgggaagccaaggagggtggatcacttgaggttgggagtttgagaccagcctggccaacatggagaaaccccatctctactaaaaagacaaaaattagctgggtgtggtggtgggcgcctgtaatcccagctacttgggaggctgaagcatgagaatcgcttgagcctaggaggtggaggttgtagtgagccaagattgtgccactgcactccagcctgggtgatgagagtgagactccttctcaaaaataaataaatagcttttcctccctgatgcaaacgaggtcgcacgcatgaggcttctccgccgccgccgccgcagacgccgcggcgatgcgctacgtcgcctcctacctgctggctgccctcgggggtaactcctcccccagcgccaaggacatcaagaagatcttggacagcgtgggcatcgaggaggattacgaccggctcaacaaggttatcagtgagctgaatggagaaaacaatgaagacgtcattgcctagagtattggcaagcttgccagtgtacctgccggtgtggctgtggccatctctgttgccccaggctctgcagcccctgctgctggttccgcccctgctgcagcagaggagaagaaagatgagaaggaggagtctgaggagtcggacgatgacatgggatttggcctctttgattaaattcctgctcccctgcaaataaagcctttttacacatcaaaaaaataaaaataaaaataaatacataaatacataaaaataaaaatttaggaccctacctttaaaaattaaaatttaggaccctacctttttgagtgctggggttatactccaggtgcctggcattgagaataacattgaactcacaatccttgtccaaagtaagacaaatagtatttatggaagtttgactgagtggtctatacccctagcatatgtcaagatctatccctaggaaagaccaaaccagaagagagctagctaggccccagcctcttatcatctcttcttgctgaattatgctcagacatgacgccattgatctacactgaagggcatttacatgaaactataaaactcactgacctctcagttccttgatgtcctcatcttcatagacgtttttcatctacaccacctga

SEQ ID NO: 8025 - DNA, 1111 bp, Homo sapiens
atcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaacca

SEQ ID NO: 8026 - DNA, 1912 bp, Homo sapiens
tgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttcttttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctata

SEQ ID NO: 8027 - DNA, 2234 bp, Homo sapiens
ataaccacctaacatagaaagcatgttctatcttgtctcattcaacattcagacactctggatttgtatcatgtcttttgccataaactaacattcaggtgccattgaagtatatttaagtaactttgggtttataaaacttgtctctacttctctatagaagtaaaattctaatagactaaaaaagtttgacaattttagtagtatgtgaaagaacccaatatactgttttaggtgacttactaagaaagcattttggccttgttttgagtttattttttctttctctttttcaacagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttactttcttcaagattcatagttaactaaccaggaactgctaagtaaagttgaaagataacttgtacttggagcttttatgttcaagagcaaaatcatatccccattttaccttaaaagtccacaggtcctgaactt

SEQ ID NO: 8028 - DNA, 1115 bp, Homo sapiens
tctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggtaactttaataacataattgaaatttgtttctctgggttgggatctaatttcttttgtatgtgatgttattgactgcgaagtaataactaatgagtagatggtatgagaaaagattctgaaatttgtgattacgctgcttctttatgctagctaattcaaaccttttttatttttcttaatctgctagtaagctatgggctttagtggtttttcttttt

SEQ ID NO: 8029 - DNA, 1221 bp, Homo sapiens
atacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaa

SEQ ID NO: 8030 - DNA, 1230 bp, Homo sapiens
cctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataa

SEQ ID NO: 8031 - DNA, 1147 bp, Homo sapiens
ccagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtattaatgtttgcattgtgtccagtaacataagagacctctcacaggaaggttcttaagattaaagtgcttggccatttcctcaaactgtgaatttgtcatattcttaagttagcctgttctcaaggatatcatttaacttaacacttgcaggtttgctagcaattgtttataaaatcggtagaagttctgaatatgaagactgactaaaacatggcctctcactgtgcacatggtagctgcaggtcctctgcaagtgctccagtcagcacctaccacagagccccacccagactcagctcctggtaatgagtacgatgcaaaacaagacagagcctcttttttgttacaaataactcagattcttcaaggggaaagaatatggtaaagaaatgagtcttgacgtgaaactgattttatagatttgccaccttctcatgattctgtccctttcctatttt

SEQ ID NO: 8032 - DNA, 2431 bp, Homo sapiens
aatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgcct

SEQ ID NO: 8033 - DNA, 1129 bp, Homo sapiens
tgcatgaacctgttttcccatttctaaacatttttatgtgaatgtttaatgttttcttaagagtgaaatgaggaagttgaactggatttagctttcttaccttttagtatttaataattgcaaatgatagtgtattattttgttttctgctcaccttaggaacaatacaggtatgattttcctttttaaatttacaaaactcttagaagagatcctaaactcagtgtaaaactttggtgttaatattgcagttcagctttataaattttagaaatttgctttgcattttcagtaacatgtatattactcaaacgttgaatatttcatttccttgaaaatatcattaaaccagaaatcatttctacatgagcaagacttaatatcttatttaaaactgcctctcacccttacaggaaatccatttacagagatgatcataccagttattaatgtgcacttaaaacatctttagaggtagtctcttgacctgctaacaatagagagctttaatagcctacttcttgaaaagccctagtaattgtttcgaatgaacttgtctaaaatggtatctgagaaaagtagaataagataatcaaaagagcccaagactaggattttaaaggacttatgtcttgttaagtagccccctgacattgagcaagtcatttatctgaatcttaatttcttttttagaagaatgagagattgtaacacctgtcttgggcaggaagggggagggcagttattgtgaagataggaagtgtaggcagagtggagagtgagcattctacagatgctccctgtattcactacccttcttgcttttggccttatttctttacttgcaaaatggagctaaaaattcttgtcctctttgcttcactttgggatgacgggatgacatgtcattatttaggtaaaagtgcattattattgccataaaatttattaacactgagctaacagcataataagcatagttctttgtatattaaaggttttaaacccggggacctatgaccttgaatggggaaaaagttacatctttatttttacattttcttgttatgagtatagacaacattagcattagcagtacagtaccagagactgtgtcgtctatttttta

SEQ ID NO: 8034 - DNA, 1118 bp, Homo sapiens
ctgcactggcttgtatgagagtaaaatagagttcatgagtgataataattgccaaatgttttataactgtgactattagggagacatatactgaggccaccaggtggcgttgaccaggtagtcattgccatttcctgtaaggtagtagagcttattacctggtaggtgggtagatatatatgcctttgatttccaaataagctttggaaagaaaagaaaataccttcggctaggcatggtggctcaggcctgtaatctcagagttttaggaggccaagttgagaagatggcttgaggccaggaatttgagaccagcttgagcaacatggtggcaccccgtcactacaaaaaataaaaataaaaaaaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgt

SEQ ID NO: 8035 - DNA, 1309 bp, Homo sapiens
cggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtggtgagtgcgcgcgctggggcgggggctggtgccggggtgggctcactgcaccccagctgctgctgaccctcttctgggtcgccacgtatgggactagaaggccgtcccatgccccactcccagacgcagcccttcggagtctcttgcgttctgggggcagtcgcacggcgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctcagaggaggtaaagtgctctggcttctggcttctttcagttgttctgcatgtcggggggagaacatccgtgcccttttctcagatcctttttgcgggtgccaacagcttgaccaaacgggacagaggagactgggaacctcctctactctggcatcctggcttgcgaaactaatttaaagaatgtaaagttggtttcaggatgggggcggggcggcaaaagaggtgggaagctgaattgagctgcttgggttagggctgcgtgggctctgtccttggtcgcggggaacagaaggccctcccacccttcgccttcctgcaaatgagaagagaaggacacttcctgaaggcaggagaaccagataggcccgcgggcctccttccagctctgacggtctctggcactcacccgcagacttcggatgtgtggccaggctggaccatacaggaaactcg

SEQ ID NO: 8036 - DNA, 1187 bp, Homo sapiens
aaatatgaatcaagctgtacagtggttgtatctatggagttgggattatggggaactttcatttgtacattgtatgtttgttcttgtgttttaaattttttcacaatgagtatacactgcttttcctactggaaaaaataggtactgtattttcatctggaacaaaaatgagacagctctacagttcaacttagagacatgttagcatgtagatcttttggagaagctccaacgagagaggaagctaaggcaagtgtgtcttattgctgcagtatatgtctccctaccaattatggtctcctgctcaatgtgttcttgaattgttagtcagcaaaatgaatactttttactctttcctaaattctgtcaggctacacatattttataattgatatgtagcttgtcattccagtgttctagtgccccttatatttcagcatactgtagctggttaagatagtgtcacatagtttcattcttttttctgtgcatttgtctctccatctgtgagtacagcgttgtgttgatccttgcacatattccatgtatctctctatactctgactttgaatctgctaatcaaacactgtacactttagttggtgaccactgtgtcctaaaataatatattgttactgtaaatacatgataaattattttctctgaatcaggtaacatctcactataaatgaaggtaaccacatgaaggtatttgaatatattacttacagtacttgaatatagtataaagtttttactttatactataaagtataaaagtaatacttttatacttttttccctaataagggaaaagtcacttattaggtaccaggagacttgtgtaattatccagctctattatgtacttgggtagttacattatctacttggggctaataatgcttgctgtggtaacctaacaaggaatgaacattcattcatttgttcattcatgaggattaagcaagataatgtatgtgagagtattctataaatggtaacatacaatgcagatgtaagtctgtacttctgttattgtgctaatacagagtctctgtgatggcataggtggcagtgatgtcatgatggtggtgggagtccagaaggaagatactgcaaatacttttttcaacatcactttctcataactaacaagatcttttctccagaatagctctattttt

SEQ ID NO: 8037 - DNA, 1181 bp, Homo sapiens
tcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattagtctcagcacaggaattgaggtgggtcaggtgaaggaagagtgtatgttcctatttttattccagccttttaaatttaaagcttattttcttgccctctccctaacggggagaaatcgagccacccaactggaatcagagggtctggctggggtggatgttgcttcctcctggttctgccccaccacaaagttttctgtggcaagtgctggaacatagttgtaggctgaggctcctgcccttcggtcgagtggagcaagctctcgagggcagcactgacaaatgtgttcctaagaagacattcagacccaggtgttatgcaggattacatccgtttattatcaagggcaaccttggtgaaagcagaaagggtgtgtgctattgcatatatatgggggaaaaggcaatatatttttcactgaagctgagcaaccacatattgctacaaggcaaatcaagaagacatcaggaaatcagatgcacaggaaataaaggaaagctgtgctttgtcattgaatcctaagttcttagctgctgatgcaagttgtcccccaaggccatcacaaagcagtggggcatgagctgtgtttcaggggccactaaataacagctggtactgaccccagaaaccgccttcatctccattcggaagcaggtgacacaccccttcagaaggtgccctgggttgccgagtgtcagaatatactcaggactccagaggtgtcacacgtggaactgacaggagacccgccaccgtggaggcagggggc

SEQ ID NO: 8038 - DNA, 1105 bp, Homo sapiens
agtattacagcaatattcaaagaaagaaccacagatgtgttaaccatttaagcagatcatctgccaaacattatattactaataaaacttaaccaacacttacaattcagtcatcaaagtaagtaaaaattagatgctacagctagctaactgtatccctagaaatgatgaataatttgccatttggacagttaacatccaggtgttacaaagtcagtgttaattctaaagatgatcatttctgccctttagaatggcttgtcccatcagcagatgaatgtgttaagcacaaagcatcttccttaaagcacaaagagagggactaactgatgctgcatctagaaaacacctttaagttgcctttcctctttgtagttagcgttcaggcaggtgacgtgtggaaagtctagggggttccattctggccatgcgagcccagctcctaccaacgtcggtaacttgagcagtccctgttgctggccagagactgcctggtcgccagcgctcaccatgggtgccaggatgcttcgcagaggcactgtgctcacggttggacttggtgtcagtgggaaagggcagtgtggggactgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtc

SEQ ID NO: 8039 - DNA, 2127 bp, Homo sapiens
gtttggatcattgttattgtgcttaatattcacatagatcgttcgtgaactttctgtaccactaacctgattttgtttggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctc

SEQ ID NO: 8040 - DNA, 1135 bp, Homo sapiens
cacacctgctcagagtagcagttctccctcaaaaaagcagtgttcagcctgcactgactgttctgcttgccaaaaggaggaagcatgcaagatacttatttctccatagattgtggagtatagagggatgtgggactacagattattattttttttccccgagacagagtcttgctctgtcgcccaggttggaacacaatggcacgacctcagctcactgcaacctctgtctcccgggttcaagcaattctcctgcttcagcctcctgagtagctgggattacaggcacacaccaccaccgcactcagctaatttttgtatttttagtagaggtggggttttaccatgttggccaggctggtcttaaactcctgaccttgtaatcatcccgcctcggcctcctaaagtgctaggattacaggcatgagccaccgcacccggcccagataatttttaatagcctttgatcatggggtgagtgagggagtaggtatacttggcaaatgcatggttctctgatttctagctctaaagcagccttatctgaatccccaaatcttgtgatgctgagtaccattactgaaccagtctgcacggtaggcatctgctaccaaaatttacctcctacctggtaggtgtcatctgataagaaagaagacaggttattttaattttttgagataatcacagaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgc

SEQ ID NO: 8041 - DNA, 1102 bp, Homo sapiens
ttctaatgcaaaatgaagacctagagctattctgaaggatatactgtggcttattagggacaataataaattttcgtttaggtgacaaggtactcggccttgattaagtcttttatcgtgatctagtaccgaaataataggcttttctgtgccacttgaataaaatataatccttactacagattagtttatttattttaatcacatttagtaccattagtaaattctcccaagtgataaaattcttttttttatcccttgtttttcagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagtcaaagtctatttcaaagtctaatcaaagtcacatttgctccctgtgtgtgtctctgttctgcatgtaaactttttgcagctaggcagagaaaggccctaaagcacagatagatatattgctccacatctcattgtttttcctctgttcaattatttactagaccggagaagagcagaaccaacttacaggaagaattgaaaatcctggtactggatggctgtgataagctgttctccacactctggcctggcatctgagaactagcaagcctctcttaggccatatgggcttctccaccaaagctgtttggcagctcctagcagaccttcttattgaaatcctcatgctgaaaatgaacacagcctagttgccaacccacatgtccttttcacctccagcaagactaagcttctttaaagcacttcacaggactaggaccctgtcctggagctatctcaggaaaaaggtgaccatttgaggaactgtgacctaattttattataatgatgcctctaattttcatttcctttacaaccaactgtaactataaggttgtattgctttttt

SEQ ID NO: 8042 - DNA, 1223 bp, Homo sapiens
gtagtagtttcttatgcttcataaagaccctgtgtcagtcattaatgattaaattaaaacttgttttttaagtgttgactttagcctttgccttttacgtttgaaatagttttatagataaagatatgtttgagggttactccggaacaaagtatttctcccatagtgtgttctcagtgccatatattacatttcattctttttctctacacctgataatttgctttatttgataagtctctctgcccacatagtaattgacaataagcattggcacttctctggttttttgatgatatgaccatttggttgtgaatttcactgctaacagttggtgaaatgggtcaagagacatctaattataaatttctcaatgattttggactgacttgtgacctctgcctctgtgctccctggttgaggttttagcagaaatattttttcttcaagagaaatgtttttcacatgattttcctggcttgtttgtttcaagtacatttagcaatattatccccctgtgtttttcttattctccttgtgtttctgacagttggcagcttcagttcattccatcagagttcagaggtcagttaccaaaaccttttgcagaaggacctctggccacccggattgttcctactgacatgaatgaccagaatctagaagagccatccagatatgtaagggctacattctcttcttgcttctctgaaaagaattctatgcctaaaagtctgttggtgtgtatattagagcattgataaaatgagaatttcttagaaagcaatttttttaaggccgggtgctgtggctcacacctgtaatcccagcactttgggagacgggcgggataattgcttgaattcagaagttcgagaccagcctgggcaacatagcaagatcacatttctacaaaaaattaaaaaataagccaggtgtggtggcttatgcctgtaatcccagcctttcagaaggctgaggcaggaggatcacttgagcctcggagttcaaggctgcagtaggccatgattccgctactgcactccagcctgggcaacagagtgagaccctgtctcagaaaaaaaccggatattttttaggatgaggggtataacagcttttgttgaaaaacagtaaacagtatcacttttattttcaaattaacctctttattttctatgtaaaatgtataatttaattttgaaggttttgggtaggctgaa

SEQ ID NO: 8043 - DNA, 1229 bp, Homo sapiens
accccatctctacaaaaatacaaaaattagtgggcatgatggcacccgcctgtaatccagctactcgggaggctgaggcaggagaatcacttgaaaccaggaggtggaggttgcagtgagccgagattgcgccattgctctccagcctgggggacagagcaagactctgtctcaaaataaaaataaaaataaaaatagatgaaaagatgctccatacttagatgttgagaaattaattttgactgtctgaaagaaatctttcccatgtgcttgttgcatttaacttggagtgtgtgttagagtgtgggcgagagtataagagtatgggtcagagtatgagatttgaaggatgatttacctggtgggaagctattgaggtgtgaagcttttgctgtggtgagtatttggattatcatagtcaccatcattctatgaaaccacataagtctgccagacttttattatgtagaagtcttcctggtattaagcaataatatgtgtttgtttctgcaggtacttcttcctgccctctctcccaccatgaccatgggcacagttcagagatgggaaaaaaaagtgggtgagaagctaagtgaaggagacttactggcagagatagaaactgacaaagccactataggtgagatttcttcagctcttaatggttgaggcactgagtttcccaatgaggaagaggattgccattctttcctataatgagtgagtgataatatgaaaactttataattcttaggattcattttctgggacagaatattttatttttatttagttatatgtattctttagtttttatttatttatttgtttatttgcttatttttcagacagggtcttaatctgttgcccaggctggagtgcggtggcaagatcatagctcattgtagccttgaactcctgggcttatgcccaaatgatcctcctgctttagcctcacaagtaggtaggactacaggcctgaaccaccacacctagctgattttttaaattttttgtagagatggggtctcactttattgcccaggctggttttgaactcctggctcaagcgatcctcctgccttggcctctcaaagtgctgggactccaagcgtgagcccctgttcctggcccagcataatttataacaaaaataatgcgtagtcagatttgtcagttccatcctgtgctcactgaatcaaaggcaatcaatctgtcaattcacagat

SEQ ID NO: 8044 - DNA, 1138 bp, Homo sapiens
gctataaatttgagctaaaggtataggagactggaagagtagataggaagtattacctggttgggattatagggtaggagtgagcatttgggtggttactggctgaaatgcagtattttctttcagaatatctaaaatgtctttatctttttctaggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttat

SEQ ID NO: 8045 - DNA, 1675 bp, Homo sapiens
taaagtatacattaaagtgcttatttaaaattcagatgttaacctcaattttttaatctagaatgcaaaatattaaaataatacgctttttttttacataaaagcttctattttttaacttttcttattagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaacca

SEQ ID NO: 8046 - DNA, 1168 bp, Homo sapiens
ctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaacatttcatcttttactttttagcaccaacagacttgataacagcctgatgctgatctgacaatgggttgatagccttcccccactgacccttaaatctgcttagtaacaagtcctttgcttctgtcattctcctgggggatggcctactgccctcctttctgtacaatctgggcaaaccgactggtgatggcaagagtggtgtcaatgaagcggtctacacagctggagagacaattttcagtgcgagagtctaggcgattccctggcttctccacacatttatcccaacataactccatgaagtgatgcacctaaaaggaaagaaaaatagtaaccattggggtctgcagataggcctaactcttgtttattaacttctcactttttgacacctgacaaaaccattctttaaatcaaccacggagtcactttgggctcttctctttcttcatttcctaattagtcaccaatattgatccagatcctcgtccctacagattgtacattctcaggtaggactaataaccttttatattccccaaagtagctagcaccattgtgaaccaactagggaaccaattaattttcccaaactattgcactcattttattccaaacctatcccctagacaaggtaattcttccattaaccttttgggggttatggatccactccccagaaaaatgcacatacaggcacagaaattatgtgcactgtcattagaatgttcagggcccaaaga

SEQ ID NO: 8047 - DNA, 1406 bp, Homo sapiens
gtgagctatgatcaggccactgcactccagcgtgggcaacagagtaagactttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgcttttatatattagctatcagtagttttattcattagaattaggtgtccattgcatccacagcatgaaaacaaaattgggtttttttttttttttgagacggagtcgcactctgtcacccaggttggagtgcagtggcgtgatctcggagca

SEQ ID NO: 8048 - DNA, 1148 bp, Homo sapiens
atgaatctggctctagcattccatcagattaccctcctttctcgagtgcccacccaccacccaacggaggttccgatgccattttccagtgccaaccgcaccctcaaccacctttccagtgtcaaccttagccttagctgccaagattccccagagctcagccttcaagcctttcttcatgattacacccaagagtatcagactcgaaggcttggccaaccaagtcttcagcagccccatcacagaggccatttatatcctgcttgcttttctcaccagcacacttctcttctaaagggaagccagggaaacaattgtttctgcctccactgcatcctcctacattcagttccaagctagtgctgggaaccgaatgtgtgtaaatgaaggctttacattctcaaatgtgcaactttgctgccacggcttcagaccaaaacaaagatctggaggcactcattggcaggcttgggtcacatagatgttcatctggatctttcaggacacatattacactttttgaaaatatttagaactggccggaacttagtcacctaggttctccctattggttgaacaggttggcagccaattccacagccaatctcaacttttgttcactgccaaatgattcccctgcaacctctgagtttctgtgggaagaatccttccttactttcaagatgatctcagatttctaaccaaacccattcaggttacaaggaacttctgtgactcatgtgactcaagaaagaaaggagaaaggagaaatagctctgaggctgctggcagcttcccatttgtccacaccagtagattttgaagggcaagagaacaggaacgaaccatgtctgagaagccaatatagaaaaaaactatgttataaaaacatttttgtcacaacaaataaattatactttaaacaagaataatgaatgtgttccattcaaatataagtctctaatgagtaagttaaaacacagagaatgttgtctaattgtattatttgtgtgtgggtattaaagaacgaatcaaatggtgagtgtatgtgtgttttcaagaccagactttggggcaaaactatctcaattttcatttccctcaagtgaaaactggtcatttttcccctaatagtaatttctgttaag

SEQ ID NO: 8049 - DNA, 1189 bp, Homo sapiens
tggcgactcagaaggagaagggaggttataacagggattgagccctatcctttatggttacttggctcctgagcctacagggcttggcctgtagaggattgtgacagataagcttagacacctgtcccagaaaagaagaagtgaggatgcaaactttgattctaaggtcatggcatcatgtcactgcagggcttcctccaatgactccacggagccgtggctttgtccaccagctactgaggactctgtgtaaatgggactccccaccagcagcatgtgtgagatgagaagccccctgcacccctctgtccatgtgctgcatgtctgagcatggcgccctccccagccattcataatgatattttttttctttagctactgacactgactcgtactaggaaacgctgattctgatgagctaagctctttaacacccactcttccttcttagattgaaaacatcactaaccaccccttccactccctcctttattttttcacagctgtgtgtctggattgccacgatctctggcaggtcgacacagacttttcaccagggtttctgctctaattgcctttatctctaaggattccctgcactggaggttcctagggtagagagtcagtgggaaggggctgaagaaaaaggcagtgaggtgtgtcagcccgaatcctgtgggcagggactgtgggcagggactgtgggctgctgctggccttggaaactgccagttcccttagggtcaccagtatgggggctgaaactccccaggagccacattcttcttcataaccaatctaatgtccatgaaatagagttgaagatgggcacgagcccccttgtggccttggaggcaggagccgagttaactgttgatgatagcagttatttctgtcataacttcctcagcctggatcagccccataaccacaagccataccttcctggtcatattttctttttaggatgatgaaacaaagataattgatcaattaatctgttggtgttttcatgacacctgcgagaagggaactggtatttttgtggttcagtctgtcagagctcgttggttgctgtttaatttgtaccttgtgctgccatttgccaccgtaccccaacacatactctcacattcataaattcctcaggaaactggtgctggaaaggatttacagaccagatgcctta

SEQ ID NO: 8050 - DNA, 1098 bp, Homo sapiens
ccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctattatgatcatactggggtttatttcaatgcggtgagagtctgttatgtgcatcaaatgtggacatgcgtgtggtagttcctttaggaccttgtgtgcgaggaaggttagcgaagtctcagtgtcttgagttcatgtgttgcctgaatgatgctttctgtattttttctcacaggctgatagatgagagtcctaatttagaaggggcagacgtcagattcagaaaggtttccttcgaactctggttctgccgctccccggttgaccttgaaagagttgcttaatctccccaagattcagtttccttttctgacatacaggaaataccaagaaaagagagttagttagggtgctggttgatgaatgaaacaatgtacatgaaggcctagtgtcttctttcttggcacacagtgggaactcaatcagcgggagttggcgctgttggca

SEQ ID NO: 8051 - DNA, 2341 bp, Homo sapiens
gtatacactgatatattgtaaacatttgaaagaaaataattaccatcatatctatgctagagtatcatatctacttccttgtattttaagaagacaattggttagaagaccctttcgtaataaagtaattatatagttgttatatagcagtgagctaaagtttggtttatttgcctttgctcctggtttggcctgaaggaataatcatttattagtaactggccagcataatgctttgacctttgaggttaggtaaggggctaatagaaggcttgttcacttttactcagaaatctgtttagctgtatatgtaaccatctgttttccctccacagaaaatctgcagctgtgcctaggggagtttctacccagacttctagatccttctgcagaaatcatcgtcttgaaagagcctccaacaattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgtgcagtatggtctttatttaaatatatattttccatttgggaaatggacatacttggtatttgtcttgttccaatttttcttctttaaaaccaaaaagcagattagagggttgataaactggatggggactgacgcgccagtgtttgaaataaaaggcaacagtcaattattgagcagcacctagtggtaactgaagctttttaatctcattggctatttgcattgcatgtaagcttatctactttgtcaaatttttgaatgcaaaaacagcaattttcttagaatggagtttcttatgtagtcattcctcagcagacaccggcaattgctgggacccctgcatataccaaaatccatgcatactcaaattctgtagttggctttgcagaacccacatataggaaaagttgaccctccatacacttgggttttcacatgctgtgaatactctattt

SEQ ID NO: 8052 - DNA, 1106 bp, Homo sapiens
aatacaaaaattaactgggcatggtggtatatgcctgtagtcccagctacttgggaggctgaggtgggaggatcacctgagcccaggagttcagggctgcagtgagctgtgatcatgtcactgaactccagcctgggtgacaaagtgatactctgtctcaaaaaaaaaaaaaagtacagtatgtttttggtgccagaatgctaaaagagtttcatcccttatgaaatgcaagaaacttaaaaattccatagttgtttttgtaattcgatatgaattttttagaagtctttttagagtcaagagactgcctagctcctaggcatcaatttctgtgtgcagaagcccacagcacactattttctaaccattgattctgcccttaataggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaaggtgagaagagaatattcaggtgaatcccttggtctgggttgggctagatggactcctctgttggggaagttttgccctgtgccttttcattgctttctgaactttgtcccacacagatcaatcagcattatgaaggtggctcaagcgaaactgaaggaaattggtccagatgacatgaatatggaagagtacaaggtaaagtgttttctttaagtctatagagcaaaaacattaattcctgaggtaaatggtacctgaggcaaaataaacaattttgtgctattacaaactgacttgttcttccactttcccctcaaaatcctggtaaagaatggataaatgatattttcttgccctcagaatagcaggtctctttattttcattcttcatttagagtgagtcaacatttcacttcccttaaatacctattttagccttgtcctaggcagtaaaattcttgaaatcatgcttttggtttgttttaaatgataaagttttaaaaatacgcattaaaatacatagctacacatgttttcaatt

SEQ ID NO: 8053 - DNA, 1600 bp, Homo sapiens
aaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattat

SEQ ID NO: 8054 - DNA, 1163 bp, Homo sapiens
tggggttagaggacagaggggaggacataaaaacaaactgatggaaattcacccaactctggtgtcttggtacattttctgttccccaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtgtgagtaccctggtatcttattctgagggcgtagagttgcagttacatagaaactcttcagaagccatttattcaatgcattcattttatatagtatacatagaattcttatttttgctagaaaaataaaggattattttattgaaatattgtactgccatattacagagtgccaatgaggatttgaaaatgctacattgaacccaaaggtaaaactgaaataatatcaatctgctctaacacgtgacttaattaatttctttgcatatagactgtcatcatttctatgccaactgcaaaatctagggtaattttccccctttttttatcccatcataagtactgaagtttttatagaagggatttttttcccatttacgtcggcattttgttttaaatgacattcctcctctattttagcttaaattagagcaatgagttgaaaagtcgactctttgggatcattgccacaatcttgatggcttcatcaataaaagctagattgtagtgagtgaggttttctccttaccatgccctgtagactgaatatgttttcctcatcttctcctctggacccttctgcttaaaaggaaaaagtctttttctgcacaaagccattcttatgccaaggttgtggctaagtagccagcttctcactttgtatttggcttctgaaaaatcaaggtgatctttgagtatgcatactgaaatgttaccagagtttggttgggatggtagtgattggatgtctgataaaggaaaagctttaccctttgtgaatcattggattaatttcctagggctgccataacaaattgtcacaaacttggtagcttaaaatagcagaaacttctttccttacaacgctttaggccagaagtccaaaatcaaggttttggcaggaccacaccccct

SEQ ID NO: 8055 - DNA, 1215 bp, Homo sapiens
aagcagtaaaaattattaattttatgaaagcttgaccttgagttacatgtttttaaaaatagtttgtgtgaaggagaattacaaataaagcatttttgctacatacttgtctcaaggaagaagactggggagattgagttaaactatagttattcagacgcgtatttggcagacattttctggaaagcagtgagcctgtcattttaagagaaacaatggacattgttgtcagtgataaaattaaagatttcaagtggaaatgtgaattttttaaaacttgcatcttcctctgtgaacttgacagcttcctaatgaaccattgacttttcttatgatattggtggtgatactaatgaatgtgacttttttgatactgaataatgaaatgtgtcaccatttggaagagtgctgcataactcagtgaactaatattttccaaatgaccagtgcatgattttaaaacatcatgagtggctaaaagatccattcaaagtgcaggattgactaatgaattttaatgtgacagagtatgagaagttctttgatgtggtttcagattccacaatccaatttaaccatgaagaagccaccacttgttgagttttggtatagtatcaaaggagaataaaaccataattatctgaaaagactattaaaatacttttccttttacaactatatatatacatgaggctattttatttcccatatacttcaacataaacaatggatcacaacagattgaatgaagaagcaaatgtgaaaagccaattgttctctattaagccaaactttagatttgcaaaattcttttctaatttttttgctgtggaaaatgtagttattttcacaaaaacatgtcctttgtgttaacacgcgatgggtttattaagtggattcataagattctttaaaaaatattatcagttttatttttaagagtttaaagtgatcctgacattatgaactttgagaaccacacccctgacgtggtaaaattaaattttcctatgaatttttatggtttaccagtgcatgagattgccatcttgtgacaaaatagggaaatgcaagtatttttgaaaagctcatctttaaggacttggagtgatttctaatgactacttgttggaaatttatcaagagaaagatataagttcagatttccaagggctatgtcttaaaatatatgtgccaaaaatattaattttcaga

SEQ ID NO: 8056 - DNA, 1128 bp, Homo sapiens
gatatttcataagtatttcctattattattattattattagcatactccctacgtgcaatatatcttgattctgtcatgggtctatgtttcaggattggttccaatataattagagactacaactttaacaacacattgttttattccatttggttaatgtccatacctttcttaaacactatgtaagtattatacatcacaaagtattaaatattgtcatcgtatcaaatacatctctgtgttcatattgctgaatagtagtctactcttaactattttttagttgaagtataacaccagggaggtacacatagtgtaaatgtgcagctcagtaaattgtcgcaaaatgaacacccgagtaaccattaccgaggtcaagaactttgccagcagcaccccagaaggcttcctcatggcctctcaaaattactgcgcttccttcctccccagtgataaccaggatttgaactataatgccatagttctacatttttttgtttgcttttgcttttgacattttaaaaacttcttattgttgaaaatgtcaaacacacaaaagcagagggcatagtgtattgaatatcatgttcttatcactcaacttcaacagttattaactcatgaccaatattatttcacctgtaatctcacccactcccccaaccatggatcattttaaagaaaattatagacattgtactatctttccatcaagatttcagtatgtatctctaaaagacagggattcttttttaaaaagataaccacaataatattttcttacctaaatacttttgtaccaacaatatccaggcagtattaaaattctgtaattgccttatattattattactttgaaaaaaacctttttatttgttgagtcaagagtcaaatgaagtccgtgagtataactacttgattagcacgccaagtttttcttagcctatagcttcttcatcccttttttctccctcgaagtttaagaaactggactgcttgtcccataattgcccacagtctgattttgcttattatgtcttcctgatgttgtttaacatgttttttaaaaatttttttatttcttattagtcaaataagtctatgagattcagtcttacttttctttt

SEQ ID NO: 8057 - DNA, 1105 bp, Homo sapiens
aaaggaccttttaagttagaggcattaacctttctttccatcataactctcagcagatatatctttttcagcatgacctactgtcaagtaaataatgatttgatggcaatgttcaagaaaaattgtatctttgaaatacaaatttttgtcagtgtcttaatgtatagtatatgattggtattatccaagaagaagaaaagatgaatcaatttcttctagaattaggtggctaatgcttcaagcatcctatttaaaaacaattacatgtaggcctgtcggcaggattgcttatttcattattctggtcatttgcatgaaaacaagttgatgattctttaaccactgttcagttttcttttccttttgaattattattcctcaagcattatattccattcatgcaacagcatgaatcagatctagaaagttagaatttcagactaagatagtagcagattttttttcaccttttttaaccgaaaatgatctcccattttcatattaatttacctgtgattacatctctttatccttgtttcataaggtgagtgcatagagttatgttttaatagaatatttttcaaggttttaggatttttttaaatgaggtcatcaccttcaagattttgacctgaacttttcatgaactaaaggagcaagaaaaagataaattttttaaaaagatgaatatataatgtacttataatggaataactgatcgaagttaaattcatttgataacgtttatctggtgctagttcccaaagcactctaccatttcaacaagagaaactccatgttcatacattggatctcccccataagattctctttgaaaaaagtgttttacttttttaaaaaatggtttaaaaaccactggacttaatgaatctttcaatttccaaacaacaaggctggagcaaatgaagcctggttactgggagagcacatcagggctaagaccaaagccgtaggcagtaacaaagaatacttatttgcctgacctttcctctcttcgtattctccttggggttctggaaggtgggactgtggccacagcagagaactggttcaggagctgagatttcagatcacgggcacctct

SEQ ID NO: 8058 - DNA, 1332 bp, Homo sapiens
taagaccatttgtcatacttttcataagaaggtgcagatataacaaaataggtggattgttccctgattctggggctggggtcttctacccctggcccatgtgggctctgttgctacccactagttcagtctagccatgggaaattggaggccaataaaaagaaaaaaacccaaaactcattctgttcttgggaaggtgggaattggaagctgcctgcagagagggggagtggcacagcggcactgattgtctctccttgaccttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatcaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaact

SEQ ID NO: 8059 - DNA, 1099 bp, Homo sapiens
cacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaaca

SEQ ID NO: 8060 - DNA, 2088 bp, Homo sapiens
tcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaagaccttttgtcctgccttttgtccttccttttgtgaggcacttacttacaacttggttacttagttggacagcaggaagttgtgtagataggagcctgattgtgttcttaggctgatagattatttgcctgtggtttggagtctagttggaagaagcctcaggtaggtgggagctggagcagtggaggctggagaggtctcccaggctaagggtggggctttgagtgacttaagaaactcgcattctctagaagcctgaactctgcttcacactgtgtccctgggcacccagctcggactctgccctgtcagaagggagcatttgaatttgctgggccaggtggaaaacagcttccttgaaagggcacttttgaagagtacagggaaggatccttaaagagtggacacaggctggacccttcatgacgtgacccccattggccgagtgaaaggatagccaaataagtatttggaaagaaagggaggggcctggcatggctcacgcctgtaaatccagcacttctggaggccgatgggggtggatcatctgaggtcaggagtttgagaccagcctggccaatgtggcaaaaccccgtgtctactaaaaatacaaaaattagccaggtgtggtggc

SEQ ID NO: 8061 - DNA, 1334 bp, Homo sapiens
ctctatcctctactagactgtaaaatgagggcaaggtctatgtctgtaaattcacattttatcctgtaacagtaagcatttggctatttgttagattaataaatgaatgaatgaagataaataagaggaagaaattctaattagtattacctaagcaaggtaaaaatggaaaaataggtatatgaaaatcctgtataacccaggagtctagaaaagttctgtaaataagaaagttaacagaaagtcctgccccaagcccagttactagagtaagaggcatgacagaataagctgccaccttgagcttttccttcctgtctctcttcaggcagtgccagcagttacccctgtggacgaggagagctcagacggggagccagaccaggaagctgtgcagaggtaatgtgacatctggcagtgcttgcagaagcccctgggcaggctcccctgcaaccagcgaaaggtcacctctgcccaaggaggtggtagagtgcagcttcaacatttgtgtggtctctttgctcaagccagatggcatgttccaccccacatggaagtaacagaagactacccagaaaatgtcatttctgtaagcaccattggaagtcccctaagtgacagcaataaccataagaactttttctttcctccctccttcttccttgtcccctgccttcatattgcaactctgatagtattcacaaggcacaaagcctgctcgtacctgccaagaactgtttactgaaaaggaattggagatgtgggatgacagtgatcctagctagtctggccatggacctctggcatggacttttcctttccaggagaatgaatacctcttgtactgtttgctgtgtgcttcttccacccccttgtaccaacaaagagatattgaaaaagagaatatgggattcgggccagggacagatgcaaatatccattgtttacagaaccttgttgagagatgcctaactcacagagaacggcagtgaccatcaggcatgctgtactgttcatttggcctcagttccgttagccctggtccttagctccatgcatgcccccttgtgggagttgattttcttattatccggggagggggtttcaccagaatccagcatgtattttcccagaaatacaggtgttcttcaagattatatgttttttcctttgagggaagttgaaataaaatggttttcatgggcttttggggaactttgggtgtctttatccaatggttattaaaacattaatggcttactctttggcaagttcacataacactgattactctacagtctgttaactgattttagctgaaaggggcaagatag

SEQ ID NO: 8062 - DNA, 1511 bp, Homo sapiens
tcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattcttttcttggcctttctgtggattatgtcatatataataattatcagaatcattctacttggctttaaaacatgttttctccaatttttttaaggttcataatttagccttttgtttttatgttgcttagattcttatgtatactgaatattttattaacatgtagcatcaggttgaacatgcttgtcattgatatatggaagatgctatagttagaagtgaatttgttctgctttcttaatcttttccatgcttagcagtgaaaaacaggttttgccccagtagagggattctttggagggtattattttttatgctgctgaatatcatgtctataatagacccgtgcatgcagcctttcctccttattccccttcatgcccccctttccccttcattccccccgccaccccgtttttttttttttttttttttttttggttcttgttgacattacaagcttttaacacatttttgacctaggagccctgttgctggaagtatagtctccagccagttactctcatgatagtactgctataaaactcattcttgtgtggtgttctgtgctatagattctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccgtgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttat

SEQ ID NO: 8063 - DNA, 1627 bp, Homo sapiens
ttctctgtggctgatctggcgtccacaccccaggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagttcttggggcccttgtttgcactccctctgggtggagctgttgaggatgaggggagaggcggaggtcttccatttccccattcttcaagccatggccctactgggaactgcaattccttgattctcccgtttttcctgtccctccagcaacagc

SEQ ID NO: 8064 - DNA, 1166 bp, Homo sapiens
ggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactct

SEQ ID NO: 8065 - DNA, 1337 bp, Homo sapiens
aacataaccaggtcccaattcctccatgtaccccacaagcttctgtccaccctattttctggacagaaattagcacaacccacaggtttttcctgggccaagtcttcctttgctgccactgtcttggcttctaatcaagctctgacaggccaacattgtgaagtcctcaccctttcccattcacttctggtctcctagtctagctaatccccctcccccagaaggttaaggcagttggttcacaaccaagttgtttggtgaccttgggtgagctccagacaggcactggggtgaggagatgtctgtgcaaaattacttgtagaatgatcttgggatgctggattttaatttttgaagcaagaaagttagggggggacatatttcctgtcctgggaaaaatggagaccaaagtgatattaagaaagtagtttggatttcaaatttataaatcacttgctctgtgggtagctatcaggaactagatcattttccacctctgcttattgtacttcttaattttaggttttatacctgggaaagctgtgactctattagagctttgaatcttttcctatccttttatctttactcctacagggaatggcctcagctcccttctcttttagaattaaacaagtaaaaactaagagttaactttttaaaaaaactgactccagggaaaggacattattatattaccaatagctgatttttttttccattctgggacctaaaatgcttacaggtactagcagtacatgtcggatagcaaagacttttcctttcagacccaactaaatgatctcctttctgcctttgatactcttttccttctttgtctttcatccttgcctatcacctcacagatggattcttcctcatttctcttgcctcacttgcccaggtttattgactagcgtcagtttaaggagctggacttcctgggacctccttggcatcttgtagggtgattggagtggcctgagtactcagctcttcagaggtcaggtgacccactttctttggttaatgaaatgttactgtctccaggttagtagctgtcatgaacaggaaaggtggcaaaatggaagaccagttctattgttctttttgtttaggggattcgttttttatcttgtaatcttaagatttcctctcccctcaactttacagcagccttaggccacctgccgtatttttcagtatcccctgcaaatttagaaattgaaaatgagtgtaaagcatattgtttcttttccaaaatcctttgaagccaaaggagtaaagaaagaaaaaaggaaggggtgaggagggggcttaactgcttcccagtaaag

SEQ ID NO: 8066 - DNA, 4975 bp, Homo sapiens
ccactgtgtgatgctttagtcaaataaatggaggggccattagagagggtaggaaggcaatgaaaccactctgaattatgtaaagatcttgctacttcttatagcctaataggaagaaatccaggcaggggttatagggcatcagctgttgaatgaatgttcaacattatgcttttaaggattagatagaagaggtctcctacctattccttttagcaccttggctgcaaagctccagaggaagatttgggggaaagagtgagcctatgaccaggaagacagagcccagccctgctatagtccagttgctctcccacagggcacctggagcttagggggttaggatatttcagtgctgcctatcatatgtagaataaagggtggttcagatagagacaatgaaattaatatggcagaaattcatgtgttaagtggaacttcttagtgggcacttcatttaagagagctaaaaaagagctctttggctagataagcccttcccatctcacttttggtcaggctgcaaccacagaaaagaaaacattgaaaacaacacccatcttctgagatgggatgctatcttggagatgaggtctaaaactaggactggtgagtggttgtgtttctgcctttcctagctttgatcccactattccctgtctttgtactccctctccttctcctctttccagccgcccccatttgtataaatagtcaatctagtttttttttttaattcaagaggcaatctttgcaccaatgttaggcttgtttatacagtccctgtctctaaagcaaatagcaaactgtgcatcctctcctactgactttggccagcagggaaacaagcttggtctcttctctgccagggtaccacagggacacacgccaaggtaacctgcgtgtgatgccagtacttctgaaactaagaaaagaagaatactttgggttggagaatttaaaggaatggtggacaaaggttcagggctgaagtttcaagcagcagaatttcccgacttaaatttgaggtgaccaagagtattcccgccagcagagtgcttctttcttctcttttctgtttcctacaggtacagtccctggaacccaccttgccagccttttccttctccatcaaggcagaggcatttggtgggtggggagggtcctgaggtgctctggccacaggtgccatctgtgtctcctacttgtgaccaaagtgaaccacggaggtgtggtccaggggaatctctatcttctgcccatgggcctcctcacttcagcagggagatgtcatcagcaaagtcatcatgctgctggcgcaggcagcggaggcagcaccactgacacaccatgaggcagagtggcagcatgaagagggcgcagatggcagccatgacataggctatggtcatgagggttgactcatctgtctgtggaatgttgtagccacagtcttccatgtccaaggtgacaaaagggccttccaccgctgccgtcctgaactcatcgtgcactggggagagggcaaatgtgaatggacagctctcattgtcatagaggagttaacaaaaagaacttcctgatagtgaggccttgaaattagcccatgcagaagttatctaatctccttcccaggagatatttaggagcaggctgggaagccagcaccaggtagaggcctgtctcccttcccaagtcactgggagcagcagcccttccttgtatacccagctggtaggagtgataactaaaagtcagtagttctgagttgaccaaaagccacccccttgaccaaaagccaaatctagtaaacttaactttctgctgctgaaatccaactgcaaaaccctgccacctttctgaagtagcattcagcctcaccatgtggcagctgacagggtcactatagactcagtctgctacccttgcatcaagagcttcccaaggtacccaggtaactcttgctgctctgggtttccaacagaggttaccaatccaggcagtggtcattatggcaggcagtacaaaaaaaggacgagcattgacactagcttttgcacaactgttgacttgggtttgaggcaactgttactaccctcccctaaactgacagggacccaggtatactaactgttgtttgacaaggaaaatatggagagactgaccccaaaccctcagccctggcactctcaccatggcaagcgctgacagcaaagccaattcgttttcgggcccgatcaaagacaacgtagaagccctccatgataacagctcccataacagtgcccgtggatgactgtgagatggcaaacttgtaacagtcgtcttgggacgtggccacatcttccactggccgcaggtattgctaggggtaagcaatcacagggtgagtgtcttcctcactctccttcaccccatctctgccttgtaggcatctatgcccttccctttaccatccctgagctctaacgggttttctgagacccctttactgctggacactactcatctgttttgtcttccaagttctggcaagccatacctgctcactgtctcccagtgtgtacttttaagagagatccccctgactcaggctgggacatacctgcggaaggatggtgatgcggaaggactggttggtaacctcacccattaggtagagtgagatgactgggaaaatgttccaaggggtggtgcctgcttgccagcacaccagctgctctcctagccagaaaccatcagggaacttctccgtctgtgttggcaagaaggggataacaatgaggaaaagcctctttatcatctcgcccctcccatgttcagatacattaactgggcccttcatttgcttttccagtgaaatatctaaagtggggaggggtaaaccaaccagaggattacaggaagagagagggagtgtgatgtcaaacttttgtaccgggggattgtgtgatgagcaaagtgacagccataaaggggaagagttttttttttttttttgaaacagtgtctcactctgttgcccaggctggagtgcagtggcgcaatcatggctcaccgcaacctccaccgtcctgagttaaagtgattctcctgtctcagccccctgagtagctaggattacaggcgtgcgccaccacacccagctaatttttgtacttttagtagagatgggatttcaccctgttggtcaggctggtcttgaactcctgacctagtgatctgcccaccttggcctcccaaagtgctgggattacaggcgtgagccaccacgcctggctaggggaagagtgttttaagagctctgagtagaagggtctaagtgcagacatcttggctgttgctgaagaatgtgactctcaccgcctccctctgacactgtaccatctcttttacccccatccttagtccactcacggaggaggctgccttgatggatttgactgcagcttcaaacactttcttgggcaaacgaaggttggtggtgccactgtccacaatgctcttgtcatagttgtactaagagggaaaagagagagttaaaagagtcaaaaggtttttgatgctgggctctgggcagtagggggttactgctggggccccagctgggttggcatcttggctttggcacctcctaagtgtacctgcttggacaagttaacctctgtgcctcagttccttcatctctaaagtgaggataaaaatagcacctacctcaaagggttattgtaaggattaaataaatcagcaatgtaaagcacttagaatcgtgcccagcagagagaaggcacttggtaaatgtttattcttgttaatcttgggtgggcaggtagtctccaaacttgaaaataaaaataccttgtttagtgcttttaacttttcttttcttttttttttttttttttttttttttgagatggagtattagctctgtcacccaggctggagtacagtggcgtgatctcggctcactctaacctctgcctcctggattcaaaccattcttttgcctcagcctcccaagtagctgggactacaggtgcctgccaccacgcctggctatttttagtagagatggggtttcaccatgttgaccaggctggtctcgaatttctgacctcaaatgatctgcccccgccttggcctcccagagtgctgggattacagccacgcccggccgcttttaacttttcttagtacatttatatctattctaatttaacatacataagaatctagggaaggaagacataaatgatttagttaccttttattgagtactgccaaccacagagataaacactttacacattatctctgatattctgagaaagttgtttttacctgttttgcagataaggaaactgagacacagaatagtaactggcctaagggtacatagctagtacaaatcagagctagattcagatctgggtcttcctgactccaaagacaagactcttcattctatcaccctgtctcacaaaagacttgcccaaggctacgaagcaaggcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggttttcttacctccttgcagtccattttcagatcctgtccattgatctccacccgcacaatgatcacctcataataccactcccgccggatgggtgtataccagagactgcctgtgtacagcgagtggtcgatacctccaatgatctagggaaaaaaagaggcaggtacccgtgtcctggcacagaaggagagtgagtcccccaaggaccaagcaataagatcagt

SEQ ID NO: 8067 - DNA, 1200 bp, Homo sapiens
tatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaagctgtggggttgcccttgcttctctgacacacaaattaactccttccgtcctccaactcatttcgtggtcatggaataagaaactaagatccaactggctgttgatctcctcagatgccttttaagcatcagcccactacatagaaaactccgtttcatcatgtgtgctttgggaatagcttatgtggtgcaccaactctagtgataatcctgggtattttctgcatcatttaaatctctgcaggtccattttctacaaggcagtcatgtaaatgtgtctccttcttttgggaggcctttgcctccttcctgagaagggaggaaggaaaaatgaatattcatagaacactgccctatgtagta

SEQ ID NO: 8068 - DNA, 1111 bp, Homo sapiens
tccttttatctgttttatctcattatccattcccatgtcccaggtcagtgttctcgaacttgtgtgcacaacagtatcggctggggggcttagtgaagcacaaattgcagggccccaaccccagagtttccgattgagtaggtttgagatggagtccaagaatttgcatttctaacagtctctcaggtgatgctactgggccaggccctccttcaagaaccaccatcctaggaaatctttcatggtagcctgtgcagtgggagtcaggagaccaggagtcaagtcccttccctgcctgttattagtgacattaatataggcatatcttctcacctctctgaggcttagttttctttctttatcaattggcaatggaaacctttgcttttattaccctgaggtattatttggaggatcagattagacaatatgtgttcaagccctacaagtgttgttcaaaccctacaaactacatgtgttgtttgaagctggtaatttcttctctggggtagaggtgttttccctctgtcttctggtggactgttctagtcttctccttttaggatgtgacaatacatctcttcatctcttaccatgaaaagtacccagatgcagggaaagggactgctgcagagagacttggagttgcatccagtagactgtcaaagtcagcacttccaaaatagagatacagttataccggtgcaaacctgcactgtggctccagaccacagaggggtggggctgccagcagacggtcatgaaagttactctcggagaggctcatgctaaacctcttccctgggcatcatggaaatcctttcagaccaaggaagaaatgcctgggcaagccaaagctttgagcctggagacccagtggaatgggcatgagtccagtcatccatgtttttatgattacacttgtaggtacatttcatatggacacacaagcagtctgcatgggaacaaatgtgcattacctgtgtgcgcagacacatgatagctggtgaggaggaagcatggttgacattgacgttgtatgagtaatgctgacgtcagccagaggggtctggctgacgtcagcatctaggggaagacttgagaaacacag

SEQ ID NO: 8069 - DNA, 2127 bp, Homo sapiens
cctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagccgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtggctcggaggtgctttcctttctgtgaaagaacttgagtgtttgtagggtctgtggaacttaaagggctagagggagtccgtccatggtcagagggaagaggaaggactggatagccacccaggcaggcacagagccccgtcagctgctgtcactgttgcctcctccccgcttctcttccctcctttccttttcttccttcactttcctctcctcctgctcagcccttcgtcccgcaccttcccgccatttctattcctccctccctctctcccgccttcccaggccactgggctcaagccacatcccatagcaggacctgtacattgcacactgtcttggagcaaaaaagggagtcacaatggcttctccaagtactcagtggcctggagtaaaacatcctaacatttctctttggtcagttctggggccactacctaaggacttgtaaagagagccaggggtggtgactcatacctgtaattccagcaacttggga

SEQ ID NO: 8070 - DNA, 2311 bp, Homo sapiens
atatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttct

SEQ ID NO: 8071 - DNA, 1648 bp, Homo sapiens
agagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgag

SEQ ID NO: 8072 - DNA, 1954 bp, Homo sapiens
ttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaa

SEQ ID NO: 8073 - DNA, 2942 bp, Homo sapiens
gaaattgatatgttctgtaatgagaatgtagtcaacatgatggagactcaaacctcctgctttaccttactctttgtttattttcctaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgagatgtttattggattattgactcactttggtgtctgcttgttgattcaggatgctgtaatgggacctaacattaaaaattaatgacatgttttttttaagagaaagtaatctgtgagagtattcattgcctttttccatcttatatgtattgtgcttccttgcgtatttttctacatttgatacatgcactcctgacagtgtagcttttgaatttgatgctacttctggcctttttggggattggagtcttaattttgtcagacggcagttggagagtcaaaaaagtcaggcttcatctttaatcttggagtcttggagtcttctcttccccattagaccgtgatgagaagtgatccagggatgagggataatgggaacaatttttgggaactgttgataattccctcagataaacctgcttactttttttttttgagatggagtctcgcttagctgcccaggttggagtgtggtggtgcgatctcagctcgctgcaaccacggtcgcccagcttcaagcgattctcctgcctcagcctccagagtagc

SEQ ID NO: 8074 - DNA, 1229 bp, Homo sapiens
ctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccagaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgtgggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggggctctgtt

SEQ ID NO: 8075 - DNA, 1428 bp, Homo sapiens
catatgacaagcctttgtgctctatagcagacactaaagactgggttacatatgcctccagtagtagtatggcacttgatgtgtagacatgtcagagcttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttac

SEQ ID NO: 8076 - DNA, 1069 bp, Homo sapiens
gcagagtattcagtttgtgtaaggttaatttttttcccccggatttgttacgagtgagggctgcctgctatcagaacattcacattcattcaggcccccaatctatctcagggttgcctaccagaaattatttaatcctataaccagtagattctatagtaggcacagggttagtagaaactactagaaaagagcatttgggatgaggattgtgaaaacctatgtatcctagtttgtgttgctttcagaatgttaattttgtattctcttcttctgtaggctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaa

SEQ ID NO: 8077 - DNA, 1254 bp, Homo sapiens
acccagggacatgcagccctacatggccacccactgtttgcagtgtctctgggtccctaagggataccattcctgtctcgtccccaaatggtaagatgacgtaaatgacccactcctaaactgaggtcagaccacctaggcttccacctggtgagccctagcagggctgagacccccagggcggcagcctgtctgctgctgagtgattcagggagaacatgtgtgcacgtgcatgtgtgtttgcccacaccggtgacacggggccctggctttccactttggatgcccgggcatccgctgctgctacatcttagccagaacttgaagtcttttgtcccagtttgggatgaaggaaaggaggaagaggcggtggctgtgtggcccccttgagtggagccatggaaggggtggcatggtgccactggggcctgtggctgtagtagccctgggccaggtaacctccagggccctgacttttccagaggctgctgccacctacttcttatcaaagaagggggagaacagttcatctgagtcagtgcacctcccctccagtctccactccctgaggatggaatcggggaaacagcatcctgccgcctcctctctgcctgcccactcaccggcaaggttgtccctctgcccagggctcagggccatgtaccagatctgtctgtgcccacccaggcacagccactgcctcccccttggctccctgctcctacccaggagagctccctatccgcctttggtcagagctgaagccatatacgactgggtgtttgtccccctactttggccccaggagtaaaaaaacttctccttttctcacttcctttcctgcctcgggaggtggcagggcagttccctggctgaggccttttgcgccccacctccaggaccaagggccattctagacagggtgtcttctaccaggacccgtccctagccttcctggcctggagggcctggtcttgcactggcagctgtaatacaaagggaactcgccccacttctcccagcctggtgctgtcctctcggcccaccatcggccaggtccagcgcttcctctggggctgacaacaggcccctgactcaccccggtcacctcccagggtccatggccagggcctctgtgtttggggggccacttgcccttcatcctgccaggcgctttgcccgccctgcctcagcctgggccctgtgcccttgagccctccacccctggcccaagacccccccaaactgtctgac

SEQ ID NO: 8078 - DNA, 1192 bp, Homo sapiens
aagaaagacaaagacccagtgaacaaatccgggggcaaggccaaaaagaaggtagaaataagacctctctgaaagagactaggggtaactctctcgtaatcctctagtaataggtaacttgtatagtaagtggtttttcaggtgtagatttctagagtcaaaatgtgagagtttatcttcccgtcaccactcgttctttttcccattaggatcatgaaaatgggtctgttgtgcgaagtgtctgccgctgtgcctgctgtgttatttttaactgatctagtggggctcggcccctgtttgaaggccaaaaacgtgtcggtgttttttttttgtttttgttttagtaatgtgtaatttatccttgataacggtggaacagatttctctgacgcagattactcgagagggaaagggtgcttctgccagaaatactaacttgtttctgttttgttttggtgagcagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggtgaggggtgtatcctacatgtgtgtttttgtaggttaaattgtcttgaccatgttaagcatcttcagtggttttgctggaaaagcagaattaaaaaaaaaaagcgtggcttgaccattggctgttagtaatgtaattctgacgtcttactcctgatcctgagatgaattctcagggttcttagccacttttgtgccgtggaccctgtggcagtttagtgaagcccaaggatcttttatgtttcgagtaaatggatgcatagaattacagggacaaccgtttttgaaataattagattactattttgaaacaactttgaaaatgtttaaaacctttatggtaaatattttgttgatgtattaaattttaaaaccagaaatttagtacggtctactcagtagtatggtctgattaccataattccacaataataaggctcagctaactatagtgactgaacgtctataattctagcactttgggaggccaaggcgggtgaatcaacggaggtcaggagttaaagaccagcctggccaatatggtga

SEQ ID NO: 8079 - DNA, 1192 bp, Homo sapiens
tttttttttttttttttgagactgagcttcactcttaaccacccaggctggaatgcaatggtgccatcacggctcaccacaacctctgccttccgggttcaggcgattcttttgtctcagcctccggagtagctgggattacaggcacctgccaccatgcctggctaatttttgtatttttagtagagacagggtttcaccatattggccaggctagtctcaaagtcctgacctcagctgatccgcccacctcagccttccatgatatatgttgttcttcaagcagtttcccctggcttaagtggggagaaagcctcaggcctcacactttttttcctcaccctgggcccggcttaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgcaatctgtcttaatcgatggttttgggggaaagatacaggaagtgagtcaaaaatggttagggaattctgggaagatgattatgtgctagtaaaaaacataacaaatatgtgttcattaaataaatgaacataagattttgaagcatgagcattggatctagtcccagaattgctgctgatttcctggggtcctggggtggtggcagcagtggtggtggctgttatgatgatgatgatgatggaacatatttcaagcacttacagccaggcattcctgctttatctcacttgatcttcaccctaactccagggggtacattctgttacagataagagatttagcagactttctgcctcaaagtttccaagctagttactgacagtctgggtttgaaccaggctttctggctacacactcagtaaaccactgttacacttcttccctccatcaagttatttaatctgtccacaacccaatagctt

SEQ ID NO: 8080 - DNA, 2189 bp, Homo sapiens
ttctgaggagactaacctgtttcttcccaaagcaggatccgagccaggagacactgagcctttggagttaggaggtcctggagcaggtgaggatggagccggggctacggtgggaagcctggtggggtctcaggaaatcctttgcaaagaactggggttggttcctctgtttcacctgcggtgattcctttgctcccccaaactcccaacagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctacagtttttgtgctgtgagtttttaaaaatagaaaaattttgggccaggcatggtggctcatacctgtcatcttaacattttgggaggccaagatgggaggatagcttgaggtcggaccagcctgggcaacagcaagactctgtctcaaaaaaaaaaaaaaaaagtatctgagtgtggggatgtgtgcctgtagacccagctacttgggagactgaggctggagggtgggtcccttgggcccaggacttcgaggcttcagtgagctatgatcgtgccactgcactccagcatgtgtgacagtgaaaacctcaaaaagtttgaataattacatcatcaaaatgttattgacactttggacttagttgagatttgtatatgtatttttttcaaggaaacaaaatactggttttattttactgctaacattatttggactcctatatcccaggcatttttaagtaacgtactttttttttttttttttctttgagactgggtcctgctctgttgc

SEQ ID NO: 8081 - DNA, 1233 bp, Homo sapiens
acctcttttcccttcagatacactggcagtgatgtctgtggacctgggcagtgagtccatgaaggtggccattgtcaaacctggagtgcccatggaaattgtcttgaataagtgagggtggcccccgtgttaagggtggggaacgagggagtctgggctccaagtgtgaatgtgttagtcatagtgcccacagcagacttcggcatctgagtggttaaatgtgtgtgagtgtcgaggcttctgagtccttctgctgcaggcacctgggcccaaaatctcttttcctcagggaatctcggaggaaaacaccggtgatcgtgaccctgaaagaaaatgaaagattctttggagacagtgcagcaagcatggtgagctagcagtccctcttcccagagtggtgggcagaggagaggagatggcagcccccagagtctgtttccttatcagtctctgtgatgtaagaggtaggtaatggtggacttgggagcctaatactagtctgctccttcttcacccctcaggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgtgagtgctctgttggggaaggtggtctcggcaacgctgctgggctcctcattggtgtgtgttcctgattgtcctgccttaatgcctggctttccttggctccaactaccttccttcccctcaggcagctgcagttctcacctgaggaagtgttgggcatggttctcaattattctcgttctctagctgaagattttgcaggtgagtggtcaaggtggggcccttagggccaggctccccaggatctagggcagtgattctccaacaggggcaagtttgcctcccagggaacatttagcaacatctgaagatagattttggttgtcacatctgaggggtgcacctgctatctagtgggtagaggccggggatgctgctcaacatcctacagtgcacaggacagccccacaacacagaattacctagtccaaaatgtcattagtgaccagattagaagccctcatctaaggtatggagccggcgggacccttttctgttgtcatctgtagagcagcccatcaaggatgcagtgatcaccgtgccagtcttcttcaacc

SEQ ID NO: 8082 - DNA, 1858 bp, Homo sapiens
cctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattttgcaagagagttgtagaattagtgactttctatactttcctgataataggggtgggaggggccatgcaatataaacaggctctactgttaactgaaggggcaaaccataggaatttaagattgtggctctgtttcttggtgttcctgggagacaatttattctgtgtgaaatgaaaactattgaggcagaagcagaaaggacgtaccaggagaactctgggcaaaagtcccagcctctgaggtaaggatgaaagggctttgtgtttgttcctatcttcccgccaactccacacgcgcacacacaacaccttcagaactggtttattagtaggattggttacattcaaaggctgttgcttggacttctctaaagagatgaagcccccacatactgaggaggcaaggcagtcatcaaggccccaaggtgaggcaaatccctggaaggcttgaaccctgcagttcagtctcccggggtaatcactccccagat

SEQ ID NO: 8083 - DNA, 1180 bp, Homo sapiens
tactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttt

SEQ ID NO: 8084 - DNA, 1165 bp, Homo sapiens
cctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctgacagtctctgtgtgcatccctgcaagggagcagttggtcaaggcaacagaccttgcatcagggtccttcagccccgccagagtcagaagtgtgggctgtgggggtacctgggctttagaggggggacagggaaggagctaagataggctgggaagactatgtcatggggagagtgcatgccaggcatggctctgtgagctctcatcccttctgatttgtcccctctcgcaacacatggctttcgaaaagc

SEQ ID NO: 8085 - DNA, 1129 bp, Homo sapiens
ctgggaatctgcctcctccccacacaggcatggcccaaccctcctgggagtctgccgccctccaactctccagaagggacaaccctggctcctccccccggctccagggccaaggtgaagggaattttgagagaggacctcaaagaagtggcagattgccctgggacaaactcagccaccctcatccagaagcaactcataaggcactttagccgggaatgccctgcagttgagctagtgtttcattctgagctcatgccccagaagatactgccaaccagcagaggcctctccagggtcaatagtacaagacctttatttaacctcaccctgatctctccaccccttatcgtcatttcctggagcagagtgcgtcttgctgaggtgagaacaaccctgctcgtgcggcctggaccacttctttctaaaactgggtccagtttctttctagatctccatctggggatcttgccttctgaggcactcatttgtggtgctcagcttactagcagcgtgacctcagataggtcccttagcttctgaacttgtgtcctcctctgtaagatgagtgatcatagttcccacttcacagattacttgaggaatgaaaagataatgtatgtgaaagtgcctggcatgttgcttagtaaatgttagtcctcgttgttgtacccttctggtgctttggcaggcaagagatgtgtgcgagcaacagtccctgccttcagtgccttcacaattcacttagggaaataagtttgttttgttttgtttttttggagatggagtctcgctctgtctcactcaggttggagtgcagtggtgcgatctcggctcactacaacctccacctcccaggttcaagtgattctcctgtgtcagcctcccaagtagctaggactacaggcgtgtaccaccacaccaggctaattttgtatttttagtagagacggggtttcaccatgttggccaggctggtcttgaactgacctcaggtgatccacccgcctcggcctcccaaagcgctgagattacaggtgtgagccaccacgcctggccaagaagaagttcttaaataggtacaatgggaggcagccctgggtgttcttgagtgtcacaggtggacgga

SEQ ID NO: 8086 - DNA, 1866 bp, Homo sapiens
atcagtaatctgcaaatgggaaagatggctggttctgtgagaccgggctgttcctggtcccagctaagacattgcagtacccacctcccaaagggagtacacccttgctttgggcctgtgcctgcctgagtcctgatccgtcttccttcctaccctgcccccggcccccttctctttctgcagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgc

SEQ ID NO: 8087 - DNA, 3154 bp, Homo sapiens
agaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgaggagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatggg

SEQ ID NO: 8088 - DNA, 1206 bp, Homo sapiens
aaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtca

SEQ ID NO: 8089 - DNA, 1291 bp, Homo sapiens
cagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtca

SEQ ID NO: 8090 - DNA, 2157 bp, Homo sapiens
gtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttatctttgtgttctgattttttttctggagtgtggggtcaaggtatgtgtttatttttatatagctaaaaaggttcattggttctgtggttgagttctctggaggattggcccaaactagtaaaagtctgaccattttgacaaatttaattggaattttgccagagttgaaaactacaaaacaaagattcataagaaacgtgttatggcttttctg

SEQ ID NO: 8091 - DNA, 1048 bp, Homo sapiens
cctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccactcatccttaacaaatgcccaagccatggttaaagttcaataaatactttgttgaatttattaataaaatggcagaaatgtcattctcttccatatatgtttaataaatccctgataggtgctaagcactgcactaggtaaaaattctcttctgatgctgtctttttggccaaccatttttttatcatttattcattagctgacatttgctaagtgctttggaggggtcaaaaggggaagtaatgagaaatcaaagatggtccctacatcaaggataaactatctttttttagtcactcaaagtcataaccctttggaaacaaaacccaccagtaccccagattttgaccacagatgaatcagtactacaaggactggttagagggttgaatgaatctgtatactcagcacttaacacagcactctgggtaaaagaaaaaagatcctcaaagatattagttggttacatcaagaaaggacaaacttaggttaatctataacttcatctcagaggaacaggaactttggagataaacagggctctgccacttgcaagttgcaccatccctggtttctccatctgtaaattgattaaaacactgcctatctaataagattaaataagttagaagcattcagttaaatgtcaactgaaactattgttcatgtaaattgtgcttgatgctttttctttctagattcaatgattattgtcattttacctccataggccctcaatagaaatcagttgcagagggcagaagcctagatattttcaccttaaaattggagggtgaaagacattgaggtgaagtagagatagagggtacacagaaaaatcgtataagtaaaactaacatcgttaacattatttactgtaagttatct

SEQ ID NO: 8092 - DNA, 1201 bp, Homo sapiens
cattttccagcctctttccatggagatcctgtaccttcaagtagggccagcgagccctccattgccttcgggccacactaccagatgtgccctcactgcctgaggaagcaggccaggaacattaacccccaatggtattgctcatcaaggattcagctgttccctagttctctaggagagaaacacttctgagtactcatttctaaagggcactgctgactcttctgtaatgtttcggaaatttggatagtgcctaaaggtggcttgcttctttccaacttttccaggcagatgcctgcgtttcaggtatccttttcattggcatagggctgcccagcttcaaaacaagctgattggagggtctgtgtgcttgcggggtggcaacagatagacaggaagtgggggttgaggccaggcaccttgaggcatagcaggaaaccctacatgggcctgcctctaatgcttcgtgctgtgttcctttttctttaggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttatgtgccaggaactgtgctaagcatgtttcatgtaagttgttttctttagttcttatagccaggtaatgcggtagaggtgtctaggagagctgcagctatttctacaggaatagatagctctgggatttatttctattagggtaacccaaaaatatgctgaaggtttcattgtttttaatccttctccttaggaccctattctagaggggatttatttctttatctgaaacgaggggatgttagtgtgtgtatatgtgtgtgtgtttgcatcatttattattccttaagcaaaatatccaaggcactgctgcgaatgctaaaagtaggagaagtgatttgtgcatggctaattggcacaggagatagaagagagcaagtgcctcaga

SEQ ID NO: 8093 - DNA, 1184 bp, Homo sapiens
cttccttttcattcttaaccctttaccctcacacttcctagtggtaatcattgttaataatgtcttgtgtatctttcatgattgcttttacttatgtacaagtattatctttaaaacacacacatatacacacacatgcacgccaaataggattgtagtgtagttactattctgtacctttttaaacaaacttaatatgtattgaaaatagttctgtgtgagcatatatagatttttaggtttcacagtattctattatatgtaccataatgtgtcacttcctctgctgattaacatttagtttaatatacatacatatacatttctttgtatattatctttgcataatttgattttatctatagataaattctagtaaaggaatttccaggtgaaggaatttaagtagtttcaggtgttgtcattacatattgttataataatgctgaaataaccagccggatcattcgaaaggagtttctgaccttttctggagtagtatttgagctcccatttctctagtattgatgaggtatgtgttctgtccccattttcgctagggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaaggtgagtccatttgttgctgccggacagtctgctagagcgggtgaggagcatatgagatcaggagcctgcatccctgggctttgcagagaagctgtttaacttcttaaaggttgccttttttccaaatttgagataacttattttcagcctatggagggatgccaggcagaggcgccaagggtccaggctcccctgctgttcacatttcaaaaggttaaaagtgaaggctcttcccatgaacattcccagtttgcccctcagtgtcagtagcctcatttcagggtggtgtcttcattttttgtgcgctttgctcactttattctctgatgacttccggtgagctctgcaccacctatagtgccttgcagttctttttc

SEQ ID NO: 8094 - DNA, 1191 bp, Homo sapiens
aactgagccatgatgtgatgtgtggacggcacaccttgctttttggaagaagaggaaaagtgtcttttcaatgtgacgaccaagctagcagcctttctagtggatagtctcaatgccggctgtggagtcgttcttgtccttgttctaagcccaggaaaattcctctggttggctgctatgcagatgggttttaaccttgagttgactctttttctagtgccagatgcccctcgaaatctccagctgtcactccccagggaagcagaaggtgtgattgtaggccactgggctcctcccatccacacccatggcctcatccgtgagtacattgtaagtaccttccatgagttggctgtatgtgtgttgggggtgctaggagatttctgggtattctgtatgacgagggggttgatttggtttagctttgtaggtgatgacccatccgtcagaacattttgctcctcaccatcttttctctcctccagcctccttgcaagatattaggatgccctggacctttggttccctttactcacattttttttcttctccctttaggtagaatacagcaggagtggttccaagatgtgggcctcccagagggctgctagtaactttacagaaatcaagaacttattggtcaacactctatacaccgtcagagtgagtgtcgtcatccattccagccatccatgcagtcttagaactgagcgaaattgctgctgttttgtgagaactctctactcacctttgtgagatgcatattagtaatctgcaaaatacccaacttcttgccctgggacgggggagctcagagtttctttcagtctcttaaatggacaccacaaagagcttgacatcagagtttctgtagataaccgggcgtttatgggaatgccgctttccctgcttttaactccggtattctgctagctttccagctcctatacttttgcagtcagctctttcctgcttatctttagctgcaggatgatgcagagctatgataagtagtctttctaaactgattttatgaggttcttatgaaatatatttttagtatttttagcagaaagagatagattttgtgaacaacatgtttgctgagaccattaagtgtgcacattcatgactctcacactgataattttgtcagtaccctttttgtatatgtgtgtatttatgaacaca

SEQ ID NO: 8095 - DNA, 4280 bp, Homo sapiens
atgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatccactgtctctgtgtgtctcgagctgttctttagagcgcaata

SEQ ID NO: 8096 - DNA, 1107 bp, Homo sapiens
ctaattttttttttaaattttagagtaatcacattcaattttcctgcaacaaaacaaaacttactggggagaaatgtcccttgttaaatggctgggccttgatgtacccttttctatattgttcattagatgtaaataaaaccatcatagtcatgaaattgataaattgctttgctttgatgttactaaacttctacagttgtaccttcctacagagctacatctcttagtacagtttttgaagttttttttttaactaagaaatacattttatgatgatgttgatagtgatggtaatgatggcaatttattttgttagtattcactgtgcaaatgaaatagagaataaagaatgagttacttttttttcatttaatcataattgaaaagtccttcaagttaagtgatgtgcaattatagtattaactgtgtctagcaatgtctattcaatttgattcattggatatgtttattcttatgttttattttgggttcctaggaataaagtacataaatttctatatctgggaagatttcaatacaaccctgcctaaaaagttaatgttataatagttaatcacacataagttttctcagtcgattttattttggcctgtcaaataattcttaatttaccactcttgttttctcttttttcctatgtctacttacagttttaatctaccaataatatggtccattgacaatgtgttggaccttgttcaattttaactgttatacagaggttacatgtatatgtgcatatatctatacattatgtattacatacatattaagcatatgagaggcacatttattcattcattcatgtattaaatagtactttactgagcatttatgctaggtgctatggtaaatgcaagattgaaatggtattttctgctctcaacgatcttgaaatgtagtgtgaagaataaaataattacaaatacaaatgcgttaattgcagttccaaagtgctgtggcgaatccaaggaagagactatttccagttgtaaaatcagagtaggcttcatggagaaatgtactttgaactggggcttgaagaacaggtaaaattttgatggacagagatgaggggggcaa

SEQ ID NO: 8097 - DNA, 1468 bp, Homo sapiens
agacttgactgagcccccgttgggactgctgtgagaaagaagcgggataacatattataaacaatagcatctgcagctggagtgatgttgggtggtttgggttcctgtacgtttggagacagagtcaaagctggggaacgtctttaagcttctgaaagctttctttatagagacgcaatgaaaatattagagctgttctatctggaaagtacaaagggaggatgccaaagtttaagtaagcttcatagcacaggcatggagaggaactcaaactgcctggtttcaaatcctgcctttgtgacctaagatccatatattcccttgagtgagctatttaacctttcaaagcctctgttccctcatttgtgtaacagggataataatgagctgactgttgtgagggttaaatgatacaatgcaggtaaagagcatagtacatacaccacgttacacatgataagcttgtaagtagcagcagctatgaaatcattaactgggacaaaagtctgcacactcagtcccccaatcctgcaaaaggaggatcctgcaaaaggagagcaagaatacctcccttgtgttggaagaaacacattgtggcaaataagaaaaggtggagcgacttcacatagtggtttaaaactgacaaaatccatcattccaaacaaatcggtgtggacaacttcagaccgtcattctgcctttcagctgtaggtgggagttgagtagcagctgccatctttctttcattgttttaactttttggaaattatcaacattcacaaaagcagagaggatagtgtaatgaacccccatgtatcttcatccagattcagtaacgatcaacatacctccagtctggtttcatcccagctgcccctatagacgggcacgcgccatcccagctccctgtgcactcggagaattctcttccttacttgcttttccctcagtggaaatggaaaacagcctgttgttaatgtcatttaatctcagtttagcttcctttaggttgggctaaataatttacgtttatgcaatttattactacaaagcatttcttgacattttcatcttctccttgattctttgaatacctccatttcctcccgtccacagaagattgtgaacccagaacaagacacaagagctctgtgagtgtccatccaagggtcgcagtgacgtgaggctaaatgcaaggcctgctgcccacccaactctaagcgcctaccaaccccaaactgtgtcacagtccctgggtctcttgcacacgcttgtgcttaatactgatttgccacttaacaagtcccttggatgtcagcaaaagagtgagtacacggaaggaaagagagcccttgttttttctttcttttttttaaattaatttttattttttaaagaacacatcacctctgccagaaccctcaactttggctacgcctacatggagaatgttttcatggccaagaca

SEQ ID NO: 8098 - DNA, 2351 bp, Homo sapiens
ttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgatt

SEQ ID NO: 8099 - DNA, 2109 bp, Homo sapiens
ggccagcaagatcagctgcttgaagctctgtgtaagagcactgcactgacggtttggagacctgagcctgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctattacatttccaggcagtatccctaagatgagatcctggagaaaggactaggggaagtatctttctggatgcttgtggtcccagaagggtactttctgtgtcataccatgccacttctttaagctcttcagggcagccaaagccagcccttttctcctactgcccccaggagaaatagcactcttctcccttcccccagatggcagggctctggcctccctacacctcataccctgcctgcctcctccaggaggaatctccggggccccttcctgactctccccaccttcgccacttgtctctaggctatgggacaatcatcccattcaccacttgacatccttgacatccttgactttcattcccccaacctccagcaggttggccccaatcctcttcacctctgtgttttcttctagaagatgcattttgggtctgagaggagcattttcctggaaggccatcttttaaggcccctgcttgctgtcatagtgcagagcagaaacttgcacactatttagagagctcccttcccacctctctgcccagccttgttacctcacttctgctctggccatggctgtgaagggcccagccagctccctgttttgatgttctgtgcaacagctccggggtcttgtgactggagatcctcaacaggccctggagccaggactggagtcttggcagctgatgagcagcaccttgccggccaggaggagctgatgctgacgatctccccaacatctgaaggcttaaagaacattgtcgttcttcagccctccttgcttctctcaatacaataagacattgcagaagcaaaagggtggcctctgctccaggcaaggcagctggctctgtctggggcatcggcctggggcttgggtgccacgtgctgagattgcatagtcaaaacagccatttttgccaacaatagcttgtggctccccacattttcctaccctgcactcaagggccagaccactctctgcatggaccagaccatcttcccaaacccatggtgctttttccccaactcaacctagactccaaggtggggagggatgggtcagaggccatagtggcccctggataatcctgacgtggggtggagtggggtgaggcagagggagcagccccaacacctgcactgggccatctatgggaaagaacacgggtcgagtgcagtcgagttgtctggccatctgtatttggatctataactgtactttgcctggcgctgtgcgcaaggt

SEQ ID NO: 8100 - DNA, 1164 bp, Homo sapiens
gtacacacaccagcaatccacattgggaattctaattgaggcttgcctctaaaatctaggttgttcatgaatatgtgacatggcttctctattttatgttggtttctattggccactggcaaatactgctctttttaggggctggtggggtggtgggaatggtgtctgaagtggaaagaaggcactaggtttggacccatgcgccacagaggcccttggaaggggtgcaaatggcattggccttgtggctccagtcttttccaactactgctccaagtggggcaacgaatgcagattttcctgctaagaacttgcagagaatcccaataggttgtacttcttttaacgcatagagttttcatgtgccagcagctgccataacacaaacacagtcccttactaactgctctcctaggtcgcttttcctgccacgtggcctccctgcccacgtcccctgggaggtggccggaaagctgagatgggggcggctgcagttgctgcctctggctgacgttcagctgcagcaggcagggttgttcaagcttggaagaatcaccactaaaatgatttgggtttgtggtggggaagcggagggcagtcccttttaagagtttcctttcacattccagccatccaccccctgaaatctttcaatcatccattcatgtattcattcaaaaattatttaacgtgttctttttctgtgtcaggcactgttctaggcactagagatccagtggtgaacaaaagaggcatgttccctgctcccaggaaattaatgttttaattgaagggtcgggggggatttggagataagcaatcagacaaataaatacatgatataatgtgagatagtgctgagtgtctcaaagaaaatgattatatggagccagagagtgacagaaatgctgttttaagctgggtgtcaggagaggtctccctgaggaaatgacagacactgagacgtagtcaaggagcaagctgtggaaatctctgggggagagtggccccaaagagggaggagaaagtgctaggtcctgagataagaaggggcatggcacttctgatgagcagtaggaagccagtgtacctggagtacaaggagcaaagcagacgtaacatggagttgcagaggcaacacagaccatgtaagggcttgggatt

SEQ ID NO: 8101 - DNA, 1666 bp, Homo sapiens
ggaaactccagtttcaatggagcaggcaaggaggagctgaaggttatcctccccaggacaaggcaggggatgcgcaggcctgcactgctctctcaccacccccagcctgggcccctgtcacccaaggttccttcccatctccacctgtcccacctgcagctctccttgctgcctgcttccctagctgaccagccaggaagggggatctgtgactggggatctatgagaaccttcgaggaagtcacaaaattctcctctccaggaacccacggctcaacattcaaagaagggaaaaccaaagccatgaccctttggtggctgagacccctcagatggtccctatacaggtgttccaatatccagaaagtcacattcatacacacacatccccctaatccatggggctcatggtatatgagcaacccaagggcagagcccactaataatttatggggatcctgcaagctctccccgcaaatccagccttccagcaaatagtccccctccacatcacacagatcaggactccccctcctcacccaccgccttggtctcctgggttgtttctgcaaaccctccaccagcgtcactgcctcctcgccactttctggccgttggccccgcacccagctctgtagttctccaggtaggacggtaagaaattgttccagcacaagcagctctaggatctgctcctttgtccgcctctctggtctcagccactggtgacaaagttctcggagtctgatgagagcttctctagggcttgctgcctcctggtagcggaagcgtcggaagttctggtgggaggtttccagcaccgggtcatccctctgtaagacagactctggccgacaggtgaaatcatcttccagtttcaccatcagaattccctcttcttcccaaagatcctggtcctctggttccacggctgtagccatttcttggctttggggtggtctcacaccatctagagctcacactgtcattagccccccgcctcagcctggacacagcgaggattttcttccaagggccctggatagagaagtaaagacaaacaagagtataagcatgaaactatacacaaggacaacagcctgagttcaatcataatcctctacacaaacttcttcaaatggttaaatcctcttttccccaaccaccatagccataaatcaacagatccagttgggagaggataatttacaactaaaggtatggtcctctactccctttcctaggcaaggttcatactctgcaagaaaatactgcatttccacttcacaaatactgccaattcccccgcttaagtctccaaaccggttcccttctcttccttcctacagactgctttagtttgagccttcatcatctcctgcctggactactgctctaacttcctaagatccctgcagtactcaactataagcaaagtacaacagaattacctgtggagattttgcaaaacatagtatcacacatcatttttcagacactctgattcagtcaattcaggtaactgtatgtttagagatgctacttgcagttcgaatgtgtatccatggttgagaaacaccaaccatgagggagatgtgtaaggttatgagcgaaagttctggagtcaagctgcctgggtttgaatcctggctctgtcgcttactag

SEQ ID NO: 8102 - DNA, 1180 bp, Homo sapiens
cttctcgccgagtaggagcctttctaggctgtgggaggtttgatcctctctatgcgccctccgcgggttgcggctcagtgctccccaaggacccagtgcgaagaagcctcggaccccacagctgccgtccgcgacccctaactccactctgcagcgaataaattaacatcttgggcctttcatttacaggcataccttctgcaagggttttctttttcttttcttttttcttttctgtttttgatcttttgtgtgtttgttttcatttggatacctctacgtgtttttcttgatttttttttctttgcattgtccgctgcaacatggtagaaaagggcagcgttaggtttgaatactggctcttgcagtcaccatcagcagcagggcctcggccgaatctctccatctttgaaccctattgtgcatcatataaaacgggcataataataccgttactctgaggactaaatgatacattgcacatgaactgaatggaacatcagaagctcagaaagaaaatagttatggtatcactgttctttcttttcctttgagtgttgcttcgtatttctttactttcaggctgtcttccctgatctcatttgttcatttttgtccgttcggtgacctttctgcccatacttgacattttcctttgctctctgtcccttttaccctgtaagtcaccactctccacgtgccatgtgccacttccttttcatgggacacattgctgggatctgtttactgggtttgaaccaaaggattagttacttttggtggagtggcagtgtattagcgaaacagaactaataggtgtgaacccagaaggcaggacaactcaaagcggggagggggcttccaggtcataggtagataagacacaaatggttgcattgagttgctgattagcctctccggaaggaggcaatcagatatgcatttatctcagtgagcagagaggtgactttgaatagaaggggaggcaggtttgccctaagcagttcccagcatgaattttccctttagtgattttgggggccccaaatcactttcctttcacacggggtatgtataaacatataaaaggagatttattataaggagttggcttacataattatggacgttgagaagtcccaccatctgcttactgcaagctggagaaataaggaggttg

SEQ ID NO: 8103 - DNA, 1135 bp, Homo sapiens
tgctgtgctctttcctaccgatggttcaaactgtagcaagggggaccattcgaattctgactacgccactcctcagaatcttgaagttaacatcccagactcctcagcatgacatttaagaccaccgatgatctggtcttacctacctttccagcatgattttctgccatttgccatttttccttctgccttcttctatgctccacacttactgaattactcaggtttagaggttagcaaactatggccctgtttttgtaaagtttcactaaaacatagccacactcatctgtttacctattgcctgtggctgcttttgtgctatcatggtgaagtttggtaattgtgacagagaccatatgacccccaaagtctaaaaggtttgctatctggccctttacagaaacagctggctgactcctgctctagttccccaattatgccatcttctttcttgcctcccagtcattgcacctgctgttctcttcaccagaaatacccttcccgactttctccattatttggctaagtcttgtctgaattctagatttaagtttaggagccacctccatgggaagccttccttaacttgccacctctagtccagttaaggtgctgctcctacacacttttctaatgccctgtgcatatctatacctgaacactttgcagaattgtgtttattgtttgcttggtgtctgctatagactctaagccccttgcaggcagcaacagtgtctgcagggccgaagcatagagcttgacacaaaataagctctcaaaacatagtttctaaatgattatataaatggatagcttgttgacactctgtccccagttacctagaagtttatggaaactgacacatgcacatgtttatacatgtcaccgtttcctgtatttcaagtgctcaagtcatatcataacagggactctttgctaaataatttgtctccaagttttcttctgcttccaactttttctgatgtgagttttgccgcatgaaaacctttctgctccatctttccctaatcagggatatgctggtgttttgttttgtttttactgtgttctggttcttttcccagcttcttcaggctgcctgagtacagataattttcttaactcatttaat

SEQ ID NO: 8104 - DNA, 1460 bp, Homo sapiens
tacacttctggtttcactagacaaacatttactgagtgcctacttagtgctagtattaaaactgcgtgttaaatctctcatcttccctactagaaagagccaaggcctttcttcctgttcactactgtgttcccagctcctgggaagatgatagcattaggaggccctgcaaacacatttctgtgagctgcagaaaggaacgaagcagggaaagaagcagagtcccagcacttgggctcactttgtcctacagtctgggaaagcctgtctgcacgaagcatgaaaaacgtattaaaacgcagtggcccagcgggggagcgtgaatgagagctcgcattggtaagcttcttgttagttcgttggttcaactatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgtgagtctgacccacgttcagccggtcccctcctggagactccctcacaaaatctttccccaagctgttcccccttcccagtgtgacagtattaatacagtgttggcttttccgtatacgttactacttgttagccttgtgtccttggacaaattacgtaatttctctgtgtcctcatctgtaaatgagctagtaactgtcttgcagaataatgaatattaaatgagtaaagaaaagtgcttggtgcgtaaaagacataccaataaattttagtcatcgttgttactgcaggactctaggaaatgtgtttgattctcgagatacagccctgagaattaggcattatttgtaaaatgagaacactgaagcccagagagatgatttgcccaagggtactgtgtcagagccctgactccaacttagataaacctgattccgttttatgacttccagtacacagactattttctgagcacctcaaatccccataactgaccctttgcccaaagaggtacatgaaactgtcagtaatttcccccct

SEQ ID NO: 8105 - DNA, 1232 bp, Homo sapiens
actaactgacagacacacacagctgcagatgtacttagagtctcatctggttcttaaggagccctaggagcccttgagaaaacaaatgtcaaatgtattagagccactttgggtggagaaattcgagctagacttcgttaaatgcaaggggagcagactgagacttcccccttcccccaactctctgggttgcattccatttagtctttcctagaggcagggaaatgggctaggtggcctttggagcacactgctggcttggtaaatttctgatcttacagatgaaataagaggccttaaaaagtataaggcctttggctcctaagcactaatctgggcaggttagaaagctactcagggctttgggcgaaagccccatatgcccattcagtaagtatataaaaccaggattggcttattgccctcaccattcacgtgcaaatttatcccttcccttcaacattggaaggggcctaaagtgggtgaccccagatttgcgtttcagttctgaagaaaacatgcaagaaaaagaaaatggcgggaggtgctcgcaagctggttcagcccattgccctggatccctcaggacggcctgtgttccccatcggactagggggtctaacagtatatagcctgggggaggtgagtgagaccagcgatatatagagaggagaatcagggaaatacgggaatggggttgagccttccctccctgttcccattagcagcagcctcttgctgatccataccaaccccagcgtatctccagtccctgcaaaaccaggtcagtgttgtctgctacacagcctactctctgtctttgtgtgatttgtcactctttgcagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcaggtaccccctctaataataaccactgtttgtctttagaaccttctctgtgctaggatatgtattacctgttctgataccttacaaggtagatatgtataatcaccatttgggtaatcccaagatgcagaaaagtggctggccctaagtca

SEQ ID NO: 8106 - DNA, 1281 bp, Homo sapiens
tatcaacctgtggctgtgctgactagatccaaagtgggctcaggtttgttctgcttactgtaggagtaggtccttggtgaagagtgtctcctttcctcccatccattctgtctgaaagagcagtgcccagtttcttggaagacccttctgacctaatcattcctattttatggctctcttattagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactct

SEQ ID NO: 8107 - DNA, 1211 bp, Homo sapiens
tatgaaacataaacccattcaatccttatgtttatttcttatgtgtaggtctgtcctcctcaacaaagctgtaaagtacttgtaccagttagctactgctgtgtaacaaactacctcaaaacccccggcctaaaatagcctttcttatataggtagctcttgtctggggagctggggtttgggtgatttggctaagctgcagatctttgggctctttcagacctctgtgggtcagcaggggcgctcttgtccttctccagggagcagcaggctagcccaggcacgtccttcttatggcgatagcagcagtgcaaatgagcaagtggagccatgcagagtcacttaggctaggaagtgacacaccatactttctgcttctgttgattggtcaaagcaaaccacatggctgagcttagaatcaagggtttgggaaacatacttgtcctgttaacgggaggaactgcaaatccacatggcaagagggtgtggatataggagggagtgaagaattggggtcactgatgcaatttagcacatgctcaagggcagattcttctctgcttgcctacagtgcctagccctgtgttgtatacagatgtatcagttatctattgctttgtaacaagctaccccaaaacttaggggcttaaaccatcagccatattttttgctcatgattcattgggttggccaggtagggctcacctgggatggctcatttctgccctacatgataccagctaggcttgcttatgtggctgcaattttaactggaggatctagaaatccatatgactggcccttatctgtgattgctggaacactagagcctctctttctatgatctttcaatttccaaggcccctctcactccataatctctccagcagggtaactggatggtgtttacatgaccagctcagggtttcaagagaatgaattcagaaggcaaggcctcataaggccaagactcaggagctgtacaacatcaattctcctgcattctatgggtcaaagcaaatcctagattcaaagggaagagaaacagaccccgctgcttgatgagaggtgtggcaaagttgcactgcaagagggcacatgggatgagagggactgttgcagctgtctttggagagacactgccacaacagtaagaagctcagtaaatacgtgttgaatgagcatttaaatgcaatgagagaagcagaagc

SEQ ID NO: 8108 - DNA, 1303 bp, Homo sapiens
atacttagggaatttgacttttatttgtctttccaggaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatat

SEQ ID NO: 8109 - DNA, 1099 bp, Homo sapiens
cttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctgtgcccatgctcatctttgtcggggcttggcttggcagcgagcgaggctggcatggggtgctgaagtggggtctcagtgaggggtgacagcgtgctggcagtcctcacagccctcgctcgctctcggcgcctcctctgcctgggctcccactttggcggcacttgaggagcccttcagcccaccgctgcactgtggggagcccctttctgggctggccaaggccagagcaggctccctcagcttgcagggaggtgtggagcgagaggcgcgagcgggaaccggggctgcatgcagcgcttgcgggccagctggagttccgggtgggcatgggcttggcgggcctgcactcggagcagccggccggcccttccggccccgggcagtgagggacttggcacccgggccagcggctgcagagggtgtactgggtcccccagcagtgccggcccacctgcgctgtgcttgattt

SEQ ID NO: 8110 - DNA, 1682 bp, Homo sapiens
tcaagttgtcaaacaacggaaataattttgagtaactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtgtctaatggttgaatttgcaaatcttgatttcgagaaatgtattcatggaatataagactttgtcttggataatttagttacagttttgagaaattagccctgaaaaatgttccctgagaaagcctggattatatgattataatcacatttatatttggtagaagagtcagattattactttttctaaagtctatatgtatatcgctactgtatattcatgaagggagaaagaccctcctagatattggtgtattgagtattaatcgagggaagccgttaaacatctggttaacagagacctttactatgtgcaagataaaatatggaattaaaaattgttgctggggccaggcatggtaactgatggctgggattccagcactttggcaggggccaaggcaggaggatcacttgagtccaggagtgcgagaccagtctgggcaa

SEQ ID NO: 8111 - DNA, 1150 bp, Homo sapiens
tctgtgacctctctactggataatactgtcttcattataatactatatctgctgttctttcatggcacattaccaataaaatattaactctctggtttttgcagccttctccactcgtctgtttgctgtcctgagatttgaaagtgttatccatgagtttgatccgtgagtacctttgcttgatctggtattatttcctttgggaggcattcaggttcatgggtttcagattcaaatttcagtcagctctcagtgatagagatgtgctttcagtacatttaagggaaaaaaaaacccttaaattcttccaaaggagataattatctccttttaagacgtatgtgttggagtccagcacagtggctcacacctgtaatcccagcactttgggaggctgaggtggagggatcacttgagctcaggagttcaagaccagcctgggcaacatggtgaaaccccatctctacaaaaaaaaaaaaaaaagtatgtgttggaattgaccaagtaagtctctgaaactcaaaaaatgtgagaggcattgctagtatgtctgcctatcacttaagatctggctaggctaagagaattctggctgcccagtttggtaaaagtttgtgatgcagattgaaggaaagggtcctggtgtgtattccaggctcagaagagaatcacaaacaatggacttgagattcatgacattttgctgtttgtttgtttgtttagcaatttatgtgatagaaattgggcttcttagttaaattctagggcaatgaaaaaactcaaagttatcagtttgataaggaattttgttcattagatgaaaaagatatagtggaattccttagtggtattaataactagtatttactaagcattcattttgttccaagcactaatttacagattatctctaaatcctttcagcaaccctttgagatgtaggtactattattcccttcttagaaatgaggagactccactgggcacggtggctcacgcctgtaatcccagcactgggggaggccaaggcgggcagatcacaaggtcaggagttcgagaccagcctggccaacatagtaaaaccccatctctactaaaaatacaaaaattagctgggcatggtggcatgtgcccgtaatcccagctactc

SEQ ID NO: 8112 - DNA, 1248 bp, Homo sapiens
tccttgctgccctttcccaaatttgactctttcaacagacaagtctttacttttttggaatgtggcttatatctgttgctcctttctcctgagctcaaagggtgcctggtgatatttaagctttattgcctaagctcctggcatcttcagtttaggtagattatcacttagctttcttggctttttaactgaaataataattttcttcctttgattgtccttgcatggcttttagaggtgtgactggtgttccaatgatgtacagatattgttaggggtagagacttacgagcttggggagattggtagccaaacagcccattctgggacagtattgatgtttgacatctcacttgatttgtctgtcctcagcatatgtgttctcagtgtcaggtttggtgtcatcatggggaattggtcatgaagtttttagcttgcttgtgctgtgagcatttctagcatttctaacatctcacatctaccttcgaaattgttggactgttttctgggctcattataaacagaatggactagtggatcctctgttctttctcagcattgtattggtgttaatgtcttattaccctttttttcttacaggatgcaggggctgggcttcttgctgctgccatgattgctgtagttcctggatatatctcccgatctgtggctggctcctatgataatgaaggtaagacttttaaaatgctgaagaagatcatctcacctcattatccaacagagcttcacaaagtgcagtctatggtttagcaataataaaaatggtaactgggtgagaatattagaaatgggcaggaacggatcttggacaagctcatgttctcttcccatcatcctttccagaaaggtagttggtaacttttcttacaagtctttggttcatctctgcactcataaaatagttaactattgttttaacattataatcatttgctttattttcctacataaagggagtggatgtccttaaaattttaatgactgattgacttattctcaattcaacatacatttgttgaatgttattgggaaaacatagtattaagtgttaggtaatgactaagattactttgtgcataattataagaaattaaagagataggtaatgaataaggttatattggcccatcatctattaaggaagattaaaatggacatgtaaatataactccagtgacaggagatagtactatgtgccatgataaaaatttgaacagagtacttcag

SEQ ID NO: 8113 - DNA, 1244 bp, Homo sapiens
ttcctatgggtacttattgtttgaccaactttcttttctggtaggttcccctaaatttttttcttttccagtatattttttctgttcatacttacgtatacatgtagacttccttaattgcttccacttgctcacatatccctaaatcctctgtgtgaccttacagtagattgcatttagattaattctgaggcttgagtccctctcgttatgtgatcatgacatcagcaaccacaagggagcaggggattgagttacagtgatgggtttgaacttgattttatattttcttttttaaaatttattttattttgtgtgacctgtacatgtaaggacttgattttcctgtttaaaaaaaaaaatcagttatttgaactctttaagccatttggcataaataaagttatagttactataagtgttctttaaagagtcacaggtgatatcctacaatatagtggtggtggtctgaggaggcatactcagaggaactgtttttttctattccatcataggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccaggtgagcccttgactgagtagggttttcagcttctactttttctatgcagccccaactagactgatttatcttagattctgttaagaagagtacgacttattcacagcctttatattgaactacttgtgttagttgaagcaacagaattactggtcattaaagtttgcatccaggagtctgctaatatttgctccgtggagtttgaattccatggctcttactttggctttaagtttgtgggaaggggagggatatttagttgagttgagtttagatgagtgatcagagttaaaatttccagtcttcttaatgcagatgaccccatgtagtagcagagattcctgatcttaatggcatctaattgtaagtgcttcaggaagtaaagcacaaacctttaaccacattgctccacagggttaacagacaactgttaaatcaaagaataatgtggtatgtttgatttctcttgtgaaattatcatgaaaatgcaaaccttatctagaggtcaacaagtatttctttactgattacctactgcagattgtccccaacttatgaagcgtg

SEQ ID NO: 8114 - DNA, 1068 bp, Homo sapiens
gtggcactcatctaatcccatggaaactaaatcatagctgtttagttggttggaaagccaaattttccttctttttctctactttgctttctcagagatgaatttgattttgctcaagtctatctattgactaattcagagcaggacttgaggatatagttgatttaatctctacagttggccttggtttgaccaaatttggcctaaaaccctttcaggtagcatttctgcctctgttcttctctccaagtttatatacagcctggctttattctgctggcagtgctgacaaaagtactctcaggtttgaaagaaaggaaggagtgaaactctctaagtattggtggcaattaagcaaaaacctaatccttctctgtcactgagaatcttattaaaatgggaagttgtgattcatttggatcagatgtttgtttgaagagtgtgtgtggaatatttattgcctctttgctgctaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccaggtatgtggcctcgtgttctgaaatggccttgttcataagaatcacaatttgattccaaatttgcaagctaccctcattcgtgttttgtttttctttgcctgtttatgttgtgtaatacagaggacggctaagcaaattttctcatgtatgaagctgagcagaagtcagaagttcaacagttgtagatattggcaagttcagcctcacagttttctgttcatttgtcatttgtgttataagttaaaatttaacggtaatttttactccggttttgttttgttttgtttgagtacttctgtcgtactccttcccctttacccttgtttttcctcttggaagtattgaagtcccataatgagtactgctgattgtaaagcctcatcaatctcttatcttctggccaatccagatgtgttttagaatttaccggtgttagt

SEQ ID NO: 8115 - DNA, 1166 bp, Homo sapiens
ccccatctcaaaaaaggtacatattcaggagttctcactacccatctctagccactgttaacattttgatgtatatttatcaaataagaatgagatcatagttttttccctgatttttttcacttcataaagaatcaaatttctctgttacttagtattattttatagaaatacttaaaatgtatcatttattagttttttaaagtacagagatgtgtcaagatgtgtaagaaggcaagtagtacataatctcatgcagcaatattttaatatattccattttataaatatagtataattagctccttgtttttggacatttgggttgtttctgatttttttgctactttaaagtgtgctgtagtaaacatctttgcatgtttctatgattgtttttttaggataaattcctggaagtggaattgctgggttaaatgtgtggaatcatccagtcatataatgaagatactttaccttgtaggtttcaacctacaggactcagctgcttatttctccttccctcttttgtagttggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcgtaactttgtattatagaagcatttttgcactttgttggataatatgaccctgggtgtcttaaaacgggagatgatatttttttcttgaaggcttgggagtattacccagtgctagattgttagaggagggatttgaatttttttttttttttttttttttttttttttgagacagagtttcactcttgttgcccaggctggagagcagtggcgtggtcccggctcaccacaactgccgcctgctgggttcaagcgattctcctgcctcagcctcccaaatagctgggattactggcatgcaccaccatacccagctaattttgtatttttagtaga

SEQ ID NO: 8116 - DNA, 1190 bp, Homo sapiens
gtggaggtcatgtttgatgaaaacccctaaattgatgtcttgatctactaataggctgaaatctgtaaattgtggaacactgattagactgatcatgcttcctgtctctgttaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtgagaagcaatgttaagagtagacttgggaaactctgtgtgtgtgtgtgtatgtgtgtatgtgggcagcggggggtgggaggagtaaagtagagcactgtcctaggtggtcagaattaactcatatagcctctgacttattttgatcaatctcatctatatgaatgtgtctaagaagttgtcctgtgttgtgtgaatttagtttggttaactacacaattaattctttttccttgtttaggtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggtgaagatttgggaggggtgggaattgtgggttaggggcaaaggggaagacatttgatgttacagtgaatcatacagcttttagatgggtggaaagctgggtgaaactggaactttgcaactctagtcttgaatgagccttaaaggtgaacctccattcaattctgggatcttttgtagttactcttactagtaattatctagactttgcatgcacacttttattgatatgatgattttaacatgaggtagaacatcccagttataaaagaagaaaaaagttatagataaataatacatgttcactttagaaaaatcagaaaattgaatcaagaagaaagatataaatcttgtgtaaagtgatcaccttatgataactgcttttaacattttaatttatatcttttgagaatctgaagtgatttcctttacaataactattaggaatatcatttctgagacaatttgttaggaataaaaacttttaagag

SEQ ID NO: 8117 - DNA, 1181 bp, Homo sapiens
attagtcacatcaaactaagtataaagaaacaggtgaaagtaattttaataattttaactgaatagtcatatcaaaacattattatttaatttaacatgtaaccagtatacccccttttggggtttgttttttttactaacttttcaaaatctaatgtgtatttcatacttacctagtgtgtattttatacttacagtacatcttaatttggactagccacatttcagctgctcagcagctatatgtagctaattgctgctatatttgatagcctagccctagctaatctataggaccaatctcagttgtggcttaagtctggactagtagcgtaggatttcaggagtataataatttctcagaaaagttgtatattttgacgaaaaatgctttgcccgtatgttgtcctcactatttttacaaattagagttaaatgataccaatccccattaaaaaaatgttgaggaattttcttagaaatactaacctgctttaactccagcaacttttgtgatgcagcagttctttttttttttttctcctagatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccagtgagtgactcataataatattaataacagtagtaataatagtgattactaatacacagtattttccatatgccaagcactagtaagtgctttgtgtctgttaactcatttaatcctcacagcaaccccaaaggcatatactgatattattgtcatattacctttatttttgttgtttgcatatttttttgagacagggtttttgctctgacacccaggctggagtgcagtggtacaatcatggctcactgcagccttgatttcctgggctgaaggagtcctcctgcttcagcctcttgagtagctgggactaaggtgcacaccacaatgcctggctgtttttaaaactttttgtagagatgaggtctcactatgttgtctgggctggtctggaactcctgagctcaagcaatcttcttgtcatggcctcctgaagtactgggat

SEQ ID NO: 8118 - DNA, 2260 bp, Homo sapiens
cagagtcaggattcaaactgacaaagagtggctccaaattctgtgcttttgaccgttactttttattgtccttaagggtattacagtgaagacaggaacaaaagggaaagaaagtgacttttcgtatcttctgatgactacattgagagttatttgattaggttaagtctctccttctgacttcaatttcttgattctgtactagggagaatttctgacatgaatgcaggtctttgacttctggtaggcttttttctctgatccatgcaagggttgctagtgtattagaggctctaaatgacaatcctcaggaatagagggccttggaagtcggctccctatgtctgtcttatcagagataagacattgactggcaagcatcatcttgcatagaacttaagctagggtaacacttgatttgcccttactacctcatgcccttttttgcaggctctactctcaacaaattgcaggctgaggaataatcatcaattagtagatggtttcctgaatccatatactgtctctctaggaaattagcactgtagaaagaagtgtgttctttttcatccctctctagagcgtcctccaggctttgaccgtgtccgaaatgctgagattgggaataaagactttgagcttgatgtcctggaggaagcatataccacagaacattggctggtcaggatatacaaggtaagcagatgctatacgtctcagaaagcaacttttatttttggagattggtttcaatgcttataaaatgggacatatatttctcaaatagggaaatttctcatgacacctgtgcttgaaaagtagcttgcaaactcactgaaaattttacttattttagattgttcttagagagtagatgatcccagtctgccatcattttggcggttgttgcagtgatacttttccagctggggcttgactaaaccagtttctgtgattatcaggctcacgggtggggagagtgcaggaaatagagaaaaagttcacatgtttatatttagctacattttcttctctctctgaagaacttaaggtatatagagtcatatagaaccacataggagtatatctctcatataagaaaagattgagaacccttgatctatgtggagggtagatcagtaatattggtcctcacagaggtattccaaaaggctaagcagagagaatctagtctctagtcagtgcttgtgtattcacagccctaaaccaggctgcagaacccaacataatcctgcccactctgggtgaatccattttagtagaaaatttctccaaagttgatctgattgtaaatattaaactgacatctttatgttgcaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctg

SEQ ID NO: 8119 - DNA, 1153 bp, Homo sapiens
gcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtat

SEQ ID NO: 8120 - DNA, 1141 bp, Homo sapiens
tgaagacgctgccactggggagctgggcggctgcgtgactccaggtgacgttgctgggggcagtagggccaggtccctgaggcccttcccactgcagttgggcaggcggaagccccccaggccaggcacagagcagggtcacagcctcagggctgggatgcactgcacaggagggctgtccctcagggggatctggatggggaagtgggtgaggctggagcaggctccactgccagtgccctgcagcccccaggcccaggcaggggagtctggaggccaggggtgtcagtgggtaggggagcagggagaagtgggttaggggaaagattgagtctctctgaggggctggtgaggaacaggctgagctctcaggtcaggggcaggaggttaccgagtgtacaggagtttggagtccccaaggaatcccagaggccccatggagggccctatctcccattctcgtctctgtccctgggcacccaggagccagcacaccttgcctcactgccatcgcccttctctgtgcctcagttcagtccgcagggccatgggaataatcacttagcggcggggtgctatgtagtgtcagtagcttccccctcccttccccttccccttccccttcccacagttttcttctcctctttccctgcctccaactccacttggttggagacctccctccaacaagagcagctttggcacacgcctctccacgggacggcggggtctgccccagaacagccccacaaaggctccagcgtgagttgtccccaggacaggtctgggcgtcacccgacccccacactcacagtagatggtgagctggacagtagtctgggtgcgggtgtccaggtagctgttgcgggccaggcaggtgtacaggcctgtgtggacacggccagctctggcgatgacataggtaggccccgtgtggacttgcgtgtggtcacggagccacacatagtgactaggtgggttggaggcagccagacagctcagggtcacctcttccctctcactggcccagaagccctcctcagtgagtcccagcggctccatggtgatcacaggcttgtcaggaccatctggagagcaaggaaggccagttacacctccccagcttcattccttcattcac

SEQ ID NO: 8121 - DNA, 1110 bp, Homo sapiens
actgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgtggttcactctttggatggaaccagtcccgttccgtatgctgtgatctatccctgccgtggaattcctccgaggctccaactccgcagccagagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcatatagcatagcccctgaaggtgggaatactccctgtttgtacaacgctgcttatagtttgtgattggggtgggcgaatgtcttcctctgaaattctttggaaccccccacccctgtcctcccctgaaactcccctgtgcacacccctctgttctgactgcagagatcaag

SEQ ID NO: 8122 - DNA, 1821 bp, Homo sapiens
gcacctgccaccacgtccagctaattgtcttgtatttttattagagacaaggtttcaggctggttttgaactcctgacctcaagtgatccacccgcctccgcctcccaaagtgcgaggattacaggcgtgagccaccacgtctggcctgtattatcagacttcctgagaacactttgaaatcaactgcagttgtgacccatgtttataataacagacctggctgacggattttacaagagtgccttccacagaagtggtaatgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcagggagcctgtcttggcgggagctctccagtctgttggattagcacagggacacgcttatggtgccatgacgccgaaactagtcatcccccatctccagcataggcaacggcctgcaggggtgagtgtcagaaaagacttactttggaagaaaagggtttttttttgtttgtttgttttttgtttttttttgtttgtttgttttgggtttttttcctgaaatttcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatatatataaacacacacacacacacacacacacacatatatatatatatatataat

SEQ ID NO: 8123 - DNA, 2201 bp, Homo sapiens
taataggacctacttcagtggtttgctaggaggattaattgagatgatacacacaaagcacttaatacagtgattggcaagtagcaaacactggataaaagtgtttttaacataaataaaagctatttataataataatagttaatgcttatatagttccttctgtgcaccaagtattattttaagcattagtcccaaattacaaatgagaaaactgagacatgaagtgccttgaccatagtcacacggctagtcagtgtcagagctcatattaaaactcaggtaatctgtgtctagaggctggactcttaattattacacattaatgtctccctacaataatgggaagtatttttattaatatcacttcaaataaattgatcagttaaactgatctgttcttttttagcaccatttgctcgcagtgccgcctcctgctcctcctgccgccactgccgccctgagtcactgcctgcgcagctcaggcctcctggcttcccatactagctgccgatatttggagttcttataacatggcagacactgacaatctgaacttgatcgagatttggatgatgttgaagaagtacatgaagaagaaactggtgaagaaacaaaaatcaaagcacatcagctaactgttcagataatgcaaagtcctcagattcttgcagtccttcaagaaagacttgatgttctggtagaaacaccaacaggatacactgaaagcctgcctagggtagttaaaagacgagtgaatgctctcaaaaacctgcaagttaaattaaatgtgcacagatagaaaccaaattctatgaggaagttcacgatcttgaaaggaatatgctgttctctatcagcctctatttgataagcgatttgagattattaatgaaatttatgaacccacagaagaacaatgtgaatggtaaccagataaagaagatgagatttcagaggagttgaaagaaaaggccaagatcgaagatgagaaaaaggatgaagaaaaagaagaccccaaagaaattcctgaattttggttaactgtttctaagaatgttgacttgttcagtgatatggttcaacaacatgatgaacctattctgaaacacttgaaagatactaaagtgaagctctcagatgctgaccagcctatgaattttgtcttagaatttcactttgaacccaatgaatattttacaaatgaaatgctgtcaaagacatacaggatgaggtcagaaccagatgattctgatcccttttcttttgatggaccagaaattatgggttgcacagggtgccagatagattggaaaaaaggaaagaatgtcactttgaaaaccattaagaagaagcagaaacacaagggaagtgggacagttcatactgtgactaacacagtttccaatgactctttaatttgtttgcccctcctgaagttcctgagagtggagatctggatgatgatgctgaaatccttgcacagacttcaaaataggtcactttttacgtgagcgtataatcccaagagcagtgtcatactttactggagaagctattgaagttgatgatgatgtttatgatgaagaaggtgaagaagcggatgaggtaatgtttaccaaatgagcaaataattctctgtgtttaacacattgagaagcaaattgaatgacttatgtattcctttgctataatcattctgcaatttgggttaaaaacattttggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtgcggcctgggcgacagagcgagactccgtctcaaaaaaaaaaaaaaaaaacattttggaaaatatgattttagaattctacagccaaacagtgtatgtgtaaagtttcaataaataaactgaaaaaaagaaaaaactttgttgagcaccttttaagtataaagcacaaaattaaagacatacaaggaaatacctgtattaaaaacatcttggctgggt

SEQ ID NO: 8124 - DNA, 1238 bp, Homo sapiens
caaggttgcgggagtctcttcactctcgtctcaaagccattttgtgccgctgccgctgcctctacggccataaatgcccagagattagcggagaagctccgagcccagaaacgggaacaagacacaaagaaggagccggtgagtccaaagggaccagaactccctagaggcagtgcgctcattggtttcccagacggggagtaggtaggagggtcctctgagtgaaagcgtgtgagtcaatagcccggacgcaaggtgggagaatggggagaaggcggaggggaggggtcagtaagggtacggtgttttcccgtgagctggatctttggctactgtcaggctcagtcctaaccactgcgtcggtacgcaggttagacagatgggtatctctgctctcaaattagtcgaaggcggcgcgggtctgatgcaaagatagtcattccctactcagattctcacccagacctttatggaaggtcttctccacggcttccgcaccaggcattccccacggctccttctttctccctaggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtaaggaccacgcgggaaaggtggaggaacctgcagctgctttctgctacaaccgaggaaaactgagacgttacttgtggtgcactctaaagccttgcattcaaattaattaaacttttgtaaactaccgtccaatataaggaaccaccgagaacacagaaataaataaataagacagtcctccctttctaaacatctgacagtaagcaattcgtagaatacgctgtgtgcagactacagggatcgctgtagagatatacaaaggctgtgtggttctagactaaaggttatcttccatcagaactgggaatgagaaaatgatacataagaaaaaagggggtgtgtgtgtgtgtgtgtgtgtgtgtgtgtatgtatgttggagtatatgtaacatacaaccccagagtgactggaatttagtggaccttcaaatgtctttcaacagatgttgcatgtagttgtcagggacagctgaagtgaatcaggaaagattgatttaaaaaatgcatttgtgaaagagggaaaaggcccattttagct

SEQ ID NO: 8125 - DNA, 3888 bp, Homo sapiens
acaggggtcaaagtgatctttaacaacaaattgggaggaagtagagtgtgggaacgtgatactgggatttgaatgaggggtaagttatacttggagcttcccaaaatgaaagagatagagcaatgtggacgttttcctcagagaccttagtgttcctgaccccacatcctttccccgtatcttccagattcgagggactgggtctggggggcagcttcaggatctggactgcagcagctctgatgacgaaggggctgctcaaaactctaccaaacctaggtaggggaatttcaggtgggggttggtatatgcatctgcaaaactggtaagatacaactcctgcctactggttttatgtgtatgtgtaatctcctgtccctgcagtgcgaccaagggaacactgggtggcatgtttggtatgctgaagggccttgtgggttcaaagagcttgagtcgtgaagacatggaatctgtgctggacaagatgcgtgatcatctcattggtaagttctgaggaccgggctgactcatactcgcgggataggggtagttgagagcagaatcacctagcgtttctcacctgtaccataaagattggtcattgctgacatggaactgacatacctgtccccctctcctcagctaagaacgtggctgcagacattgccgtccagctctgtgaatctgttgccaacaagttggaagggaaggtgatggggacgttcagcagtaagtacttacctaagtgagaaagtgcttatgtgtaggttaagtgcatagacctcagttcttactaggtatgtgactttcggcaaattccttaacctctaaacctctgtaacctagattttaagggttattgagaggattcagtgagttagtccttgtaatgtgcgtctgttctggatttctgggacaagagtctaatttactgttttagtccccttagctcagaaaggtgttaggcatttttgagagcattccttgagtttcacagctgcaacctcctccacctcccctttcagcggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaaggtcagtgcagttccccagcctatcgctgatatttctgtacttcttgtgtctcaaaatcctggctttaggtgacttttcttacgtctttttcacagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttggtacagtgcatgggaagtgtgggggcttatttggggtccctttttctccttgggttctcttggaatttgcagaagatcaggcttgtgctactacagactcgttggtcaattacagtaaaaagtcagatcagttacttgccatgctctgcttttggataacagatgtagttgcaggcaaagctaatataccttaaccagagaaacctgaatttggtcaccttcatcctgttgtcctccttttcctgaatatgtttggtgatggccaagcatataatcaagtttttctcacattaccttggaaccaaatccagagcccaagacagtgaacaggtagtcaaactaggactttttgagaggaagctgggaacgagcatgagtggtagtccaggtgttcagagttgactactttctttctctagcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtgagagcgtgggcccagttccctttacaacttgagctttggtcaatttagatggttcttacacttctatcactttttctttccaggtcaagttcaacagagccttggctgaccattctatggctcagacacctcggctcattgatggcattgttcttaccaaatttgataccattgatgacaaggtaaacgtgagactggaggctggaatgggcgtcctgcacaaaggagctgaggctgcaaggaaatcttggctccagcgcttcctgttcctgagagggtgagtgaaaagtgggcttgtgttgatgggctgtcctctttctccacttaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaact

SEQ ID NO: 8126 - DNA, 1210 bp, Homo sapiens
cttggttatcttatttctggtggaatgccagagagaagtgccccaacatcctcttgtcctggggacagatttgagtttgggggaaatgtttggctctttcccaaaggttatccaaacccagggcccaaacctgggttttctggggatagtctgaacactgagacatactctttctccaggaacggggaggtaacaactccttcacccatgaggcactcacactcaagtataaactggacaaccagtttgagctggtgtttgtggtaagtggggtgttgtagagggacgattgcattgttaacatagccctgatttttaagagaactctgattaattgcagccagtgtatatgatgacgtaactgaaaaaactagaaaggtagatgggggaaaacagcagctactgggcccaggcagggagcttggctgcctctcaggacagggaaaccggccaggtagctgaacctatctctgaaagccagggttgagttggcgtccctccattctaggctagtatgtaagcagatctgttggctgtttcttcccctaaacaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggcaagtttgagttctttggatatactgggacatgaaaggtgttaacacggtgctaaggactgaggtggtccttccttttgtcattgcttacctgcttctcactcaaatggtcaccatcc

SEQ ID NO: 8127 - DNA, 1162 bp, Homo sapiens
aatacaatccaagagcagaagtcctcatccctctttgtgagttctctttttcttatcacagggatggaggacgaaggttggtttgacccctggtgtctgctccaggggcttcggcgaaaggtccagtccttgggagtccttttctgccagggagaggtgacacgtgagtctgagcttgtttcctctagcaaccggggcataggcctagactaggtcttatcttctcactcacaagctaagcaagggctggagggggaaaggggtctccctgagagcaggtcctaggcatcttgacctgggctcctcactgatctgcgttgtgacttgtgatctgcttgatgattgcacctgagcactgtcctgtcagagtgtggccaagctcatgccagctccctcatctctgtttgcttcagtgtctgtgggaaagctcccatccttccagctttctttccttaagaaaccagtgaaatccccatttcattcctcttcagcacctctacggcctatttttcattttcttctctgcaggttttgtctcttcatctcaacgcatgttgaccacagatgacaaagcggtggtcttgaaaaggatccatgaagtccatgtaagtttctagtctgtgatgtcctttaccaaaatggagggacagggaaggtagtgactctccttgttttggttttctttgacccactttccagtatgggtaaactaaggctcaggaagcagtgcatctctcagggtgcctggtgtgtggtccgggccttcccactcctcaccctctggtgtctgcaggtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtaactgccctccggacagctgaggaggttggtgagaaagaaagaaatgacatcgaagttggatagcgtgtgtgtgtgtgtgtgtgtgtgtgtgtggggtgtggggtggacagggttggggagggttgccggccatgctgtttctgcagttcgtaaccgcactggttgtggcaggtatgtgtatgtgtggcactgcccccagggacca

SEQ ID NO: 8128 - DNA, 1168 bp, Homo sapiens
tgcgtggagaatcagacggactttcccgaaacggtggaggcggcctgtgcacccagcctgcacacccgctcccggcccttcccgcccctgcctgggctccgaggcccggggctccacgcactgctcctccgcggtcgcggcccggccccgcgctcgccagcccttcctttcgctttgggccgcgggcggagattggccgcggtgctcggccccgcccccggctccccgccctgccccgacgccccgcccctcgctcccccaagcggacatcgcccggcccagggcgcgcggacccagcggccgagacgcggcgccgcgagaaacgccctaaagaggaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccgggtgagtggcgacggccgaggcccccacccaagctctcggccagaggccgggggtcccctggacttcttccccctttcgccgttcccttctgggcggtgcatttcttcaggagcgggggatgctgttggcagctggatctggaggacgaggaggagaaggaggaggaggaggaggaggaggactgttggtggccctagacccttggtttggggggtggtatttattttcacagctgtgtttttgtgagtggtggggaaaagcttatagaatttccagcgccccattcctgctttttttattttcccaaatgagcgagaaccctctggccttattccttaatgttaaggggagatggacgctgcctcagaggacatcatcgcctgactccacgt

SEQ ID NO: 8129 - DNA, 2606 bp, Homo sapiens
ttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatt

SEQ ID NO: 8130 - DNA, 1523 bp, Homo sapiens
agtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatggg

SEQ ID NO: 8131 - DNA, 1098 bp, Homo sapiens
atttaatagttttataatgttaaagaagttatttgaacttcttagtgtcataatttccttggctgcaaaatgagaataatagtacttacctcatgtggttgtatctgatttaaaggagatattacatataaggcaggtagcacagtgcctggcattcagtatatgtttgttattattcttaatccttgtcttctttgtttgcctttattctctactcacacctaaaatcattttctttaactctgtgttatttttggacacttaatatttcctattcccagatacgtcttattttcacttatttttcagtttgtgaggttggatccaaatatgaagatatatataaaaatgatctttgtgaaaatatttactagtactaaaatctgcatgtttactatccattttctgctttggctgcactgtgtagagtgtgctgtctggaaggtggatgtttgcttactgtttcacttatgcttctccagcctgtttggttctttctgtcatgtgttcatttcttttctgtaagaaaagacagacccatggctatcttaatgttgattattttttctctttcatagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtgagtgcctgggagattctcacttctgctgctgtcatgatggtcttcggttgttctgggcacgttcttcacatattgttatgatctgcttccataacgtgttcacagttgtgtcacacatacagagtgtcttctctcaccgattctttattcctaaattgaagagtaacataaattatatataaatatgtagaagtatgcaatttcttttcttaaggaaactatatagattatatatagtgtaaatgtgattaaattcacatataccttgtatattgttgtaaataaatactgctatggtatctaaatttattgatctgtatttttacagatctaaaaaatttcaaaactgtttcaacataactttcaagttt

SEQ ID NO: 8132 - DNA, 1161 bp, Homo sapiens
tcacaattcctaattcctgggttagctcttgattggtccaactaatactggggcatattcctggaccaatcggctgaaccatggtataggatcacgtatgaacatggctgctcctgccacaggccatgtgcatggaagattacagtgggtcttggggaaaagggtttctgagtagtagggggaaatttaggcagaaaagccaaatatgtatctgctatagttatctttttgcatattcagtacaaaaatagaaagtgtcaaaattagaaaccatggaatagtatgatcgctgatgataaggggctagaaattgaagctctgcatgagacaggggctgacttgctatgtaagtgcccatagtgctactggtaagtttctgtgaagagtcctctgtaactattaaaatgcctaaagatctatagatttttttcttccagaaaccatccagttttccctgccagagagcatagtatctttactcagagttacactgatctttttcttttcagtcggtcactcagatgcttatggcttacctgtcacgcctttcagctatcgctggcaacaagatcaactgtgggcccgcccttacctggatggaggtatttcctaattcacttttcatgaaaaatgtatatttaaattatctacttaagaaatttgatattaacataattttgatgtctattgagcttcaggaatcaaagaaatgaagtatattctcagcatctgggaggatagatacgtgatacacgaaatattttttcatctcaaatctttctttgataatcttggaaactaatcttaatatattttatgaatctcgatgatacctgttattttggtgtttagtatactaatgtatatattcagcaaggtgtacatttttttagttgacttagtaattgaaaatatttttcagttattagcaagggacaactttttaaagggtcctttttaagagtaagtattgagtgaaacattattcagtaaatagattacatatttattcttaatgtgcatatgtagagttatattgttttctcctcccactggaaattgggaatgcaagatggaaagtggaaagaatatagaactatgggccaacctgcgttgagatcttggaaaaagtattgaatctcttgtaaattacatagcctc

SEQ ID NO: 8133 - DNA, 1182 bp, Homo sapiens
tctttaccatctcagtaagtggcatcatcatccaccacttgcgcaggccagaaccccggattcttcctcctccttgatttctttttttcctcctcatctcatgttaagtctggtcacctccacctttataatataaaccgaacctgactacatctcacttttttcactggcaaaaacctaggctaggctaggctagtaggctttgtcgtctggcaaactgccagcagacttccctgcttctactcctgtccttgtccttcccctcattcttaccatacacgggagccaaaataatgttaaacgttaatcagatcgtatcattctgcttactggctttccaatatacttaatgctaaaacaaaaacttaacattttaccgtggaaataaacccttcattttggtcgcttatgaggctccatatcagtggttcttaaccagggaagattttcccctcaggtgatgtctggagacattcttggttgtcacaaattggggtaggttgccactggcatctagtgggtagaggccaaagtggctgctaaacatccaacatccagtaatgcacaggacaactcccagcagcaaaaaattatgtggtccaaaatgtttgtaatgtgtgatatggctcctggctgcttctctgctctcatcttctgctctctcttcttttcttctttgttcactgagccacagtctcagtgatgttcctttttttttttaagtagactatttttacgttcacagcaaaaccgagctaaaggtgcagaagtttcctgtataccccttgtctttacacatatgcagcttcccccattatcagcatcccacatcagagtcgcatatttgttacagttgatgagcctacattgaaacatcattatcacccgaagtccataggttacattaggattcactcatttttcccacttgttctgagaggagaaaaaaaaaaaagactgactcttggtgttgtaccttctatggatttggacaaattaataatgacatgtatccacatcatagtatcttatagagtagtttgactctgctgaaaatcatctgtgatttggctattcatccctccctctccccagcccctgtcaaccaccagcctttttactgtttccatacttttgccttttccagaatgtcatatagttagaatcatagagtatgtagcc

SEQ ID NO: 8134 - DNA, 1258 bp, Homo sapiens
ctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccagaccaatttgtgtttgtattatctgtggctgctttcagattcgaaggcagaattgagtagttgacatagagactggatggccctgaagcctaaagtatttcctatatggccttttaagtaaaagcgttttttgtttgtttgtttgtttgtttgtttgtttgtttttgtggccagaggcggtggctcacgcctctaaatcccagcactttgggaggccaaggcgggcggatcacgaggtcaggagatcgagaccatcctgaacaacatggtgaaaccctgtctctactaaactacaaaaaattagccgggcgtggtggtgtgcacctgtagtcgcagctactcgggagg

SEQ ID NO: 8135 - DNA, 1141 bp, Homo sapiens
taagtatgttggacttgtagacctgaagtcccagggatactgctgggaaaatatattgtttgctcctttcttgaactcttttatgactgctaggaggcttgggcgcctgaatcaatctagggatgtgttcttggtctttttggttcttatatttttcttccctcattaggccccttgaagacctcaagccttgccttggaatcaatgaaatatcttccagcttcttctctcttctattagagatcttgctgctggagagtcaggctagccttcctatggtaagcgttttggaaaagttggaggtacattagagttttcaaagtgttcaaatcctgaatggtctatagcttgagaagtggaactctgagttcctctcaacgctctgtagttaacttgctttgtgattcggacaaacaccggatgcatatactgcaggttgtggtggcacttgtgtggaattgctggtgtggaagagaagtctgactgggttctgcctttgctttccctcagctagaggagcgagttttggattggcagtcatcgccagccagctccctcaacagctggttctctgcggcccccaactgggctgagttggtactaccagccctgcagtatcttgctggagaaagtcgaggtaagatgctcttttttgtagggtcagtatttttcccccttttgtctaattaattattagaataaactgcagctttgctcgtgtaatccatcatgcctttgcataatgctatgccttgaaggttcctgcttttctaatacattgtggaacactcaaaagctgtttcggagctcagggacgcacctgtatggtttgtttatgtggtccatttcttgcagctgttccttccagtttctctccatttgttgaattcaaagagaaaacccagcagtggaagttgcttggtaagtgatccgtattacctaccccaacaggttttcgttctcccatttcttcccctaagtttatttgccttccagtcaatatagtcctgcagattggttttaaaaagcaatatcagaccttattttgctctgtgaaggagtccttcaacaccctttttgtactctcaaggtgggttaactaactcctctggttggaccaaagctgagatggaaggaatag

SEQ ID NO: 8136 - DNA, 2137 bp, Homo sapiens
cctgctggagactggcctagctgtagaatttcagaactgaaaaagaccagagatcccctggtcccaccgtctgcttgctagcctactgctgactggcttgccttggctggcccaggtagtaagcagtggcgccgagccttgcttgtcaccacggtgctaggaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgagactgctcgtttcactgactgcggcattgatctgcgtgatggtcctacccccttcctccaggagggtgataacttcgttccacgaaggaccccagctgcacctcacaggcggaaatacgtctgctcaagctgtgactcaaggcttccagcgccgtttcgcatttagaaagcaaagtaagagggaacatctgcacagagcatttgtctggcaaaatttaggctactgatatttattaatatgagacttcttaatgctac

SEQ ID NO: 8137 - DNA, 1410 bp, Homo sapiens
agaaaccaggggcttggagtggggttatttgggaggaagtgaaatttcaggagggtttggagtctcagccatccttggcctctgcagaaagtttctttcgtctctctccttccccgtcaaaaggcgctttgggacctcgcagaggacaactgggaggccagggctttggctgccatacgggctggagctaagaactccagagttgggcttgcctgggcttctcgagaggggatggagccctttgggaaggcggctgtatgggaagggatgtgggaacacacatgtcttgagccttttgcgaagtaccgaaacaggaagctcttctttggcagaaagaacaatgaaagacctattgaaagatctcaaaaagattacatgttcctgtatggagttggggatgggtcgctagtcacttcattgacggacccacctaggtggtagtgcccgggcgggaccagcagccaggtctctaccctctctgtccaaggcagacccccaggtttcctggaaggccagggcataccaggtcagggcggcgctgagaggcaggggctgtgtggcagagagttttgctcctctgcaaatgatggcctccctgccctgccaaccctcactttctcccctccttccgggtgcccctgggctccatagtctccgccgttgctccctaagtcaggcctgattttggtgctgtctcagatcaattccttttgtccaagcagcatcccgacctagggagcttgcagaaaatcagacgctggggctttggaggctgcctgcaccacagacaggacctggggctgggctctgctattttctccacttttcaccctcagcaaggaggaaagcttccagtggacctgaaggcttgggcccttcccctggctgtgcctgtgccctgctgtgaggcagattcaccttctcttccttgctgtaattgctatgtttgtgtccttgctaattgcctacttggggttctagactccctgcctcttcagcagagaacctgctgtttggaatttgttatttcagggcagtccggtgcccccaccccaagtttgttctccctgacttccctttctaggactctcctgcccacacggggaaagcagggtcttcctggtcgtgtggtccagcctcctctctgagccatctcaccacctgacaagcagccaggctggggctcaccttccactcacccccaggatcccacattcagcggacttgtcttgtcacctgcaagccctggctttagtttcccccatccctgctcatttcctcctcctctgcgaagctcatttgctctctgcgcccttgggctgttccttccccctctgccattttcattctcttggcttgctctttgtcttttctcctgccgagctttattgaactaactcagtacctagt

SEQ ID NO: 8138 - DNA, 2159 bp, Homo sapiens
tcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaacttcctgctgttgttatttattgtttgctgggcggcagtgttgcctgcggtcatgtgagtgagaaaaggcatcagagtaattcattacttaaataattatctacttagagtgcacagagtagagagggttatattagacagcacatgtcaatttttggtgaagtagagcttaagtgcaaagatctcacaaacaccataccccaacttggaaggagagtataaaggcagctagttagaggacatcatccaatcctagagctattgaatcaggttcttgtgtaaagctgggtactaatgggtgggttgcatctttcaaagttgctctgattctttataaagtcacattttattgactagagaccaattggtgccatttcaatgatatcttacaaccaaggagtaaaaagtgggtacctagcaggggaaaacagctcattacataggtatgaatctatgagatcctgagga

SEQ ID NO: 8139 - DNA, 2916 bp, Homo sapiens
actaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattt

SEQ ID NO: 8140 - DNA, 2356 bp, Homo sapiens
catatttcatcctttgcctcttatctagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggc

SEQ ID NO: 8141 - DNA, 1099 bp, Homo sapiens
gaaataatatgtgctgttagtggggatttgggttctgtctacatactgtagttaaattgtgttttgaagttagtaaaatagatgatctagaaaagcattcaaaaatcagcttcagtagacgttacctagtttgcctcccctactgcctttttttcttttcctttttaagcacttgtgacttttcacatattctgcacattttctgagatactcaattagaatatgtttttgctggtaattcttgccttttcagatgatctgttgctacagaaatatagttcagaaatttgtagggtttatgacttttcagtttatttttgtttttagatattttgttttgctttatttacaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcaggtgaggtgcacaacgaaaacccaaccaggaaaactgctttctaaactctcttttcctgcttttagggcagccttctgtgtttttacatcaggttgccagctagtcagtcacatttgttacggattcccactgttcatactctaatctcctgatctgataaaattttgctgagtcttctacgtatataaaattataaacattttatagttggtattaaaaatattttcctgcagaagtagactacttgtcctcttgagatattttttaaataatacaaggtttaagtaattctgtaatggaccttaaatagatcttactggaaattttaccatgtcagatgatgcttagtgatactggattactccagactctagatgttaataaaattctttaccacttctctctatttaaaaatattctatataaaggaatagccattggccagt

SEQ ID NO: 8142 - DNA, 1825 bp, Homo sapiens
ccgggaggcagaggttgcagtgagccaagaccaccccgctgcactccagcctgggcaacagagcaagactctgtctcaaaaacaaaacaaaacaaaaaaaaacattggttcacagacttcactgattggacagtttggaaggcagataaggagaatatatttctatacagtccctaccttgaagtttctctgtcactaccatctttcagctttttaatttagtacagtggccacatgaaaatgatctaaatcacattttaaaccactaaaatatcaattaatgctttattttatgtattttttaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggtataatgccttctgtgtttttcttggtgctataaagtcaattcaaacatttttaagttcctgttagataaaaagttttgtgctcggtcatataggaaatataaagaagagtaaaacatggtaactggatttgcttgagatgctattagcactatcgtttattttttacaagttgcacattggggaagataaaaataattgaatggtatctgctgggacaaaggcagatacacatacacaaaaaagcagttaaatccagtttgtgttttattcttcattaaaatatgtattgaaaacttaccatgtgccaagcaaacatttatgatacataaagaaaaacacatagtccctgcaatgacaattaggttaatcatctaattggggaagcagatatgaaagtaaatgattacagtgaactatcaaaagtgctcatctggaggtgtgaa

SEQ ID NO: 8143 - DNA, 1184 bp, Homo sapiens
gcttttgccatcagtcactttacaaaccatttcaaggaaggacaacctctctggctcctgacacaagccaggcctcggtgcttttatctgttgtggtggtttttcttctttccctttttaaaagacgcatgaccaagacaacctagggagtttgtcttgcttgcctttgactatttccttaatccaaccatgctctcgagggctgagcagagactagactcaaggcacaggtttctggtgatggagtaaagttacagcggtatctcatgtctacacaagaagaggaacgttctgaaagctccaacaacttcttgagggggatggaccaatacagctttgggctcaggattccctagcctcctctgcccatcgcgtgcactgattggaggagtctggcccaaacactctcatatgaacctcgacatgctggagtggggtctggcaggagctgatgacagtttgagggacttgagtgtccctagcctggcagttggctcccggaagcactagacactgacactcattggtagaccctccctccccgccgttgtgtttggttcttttgcactccatgtactgcagaaggatggaaggacctgggtgctggctgggctgtgtatactgtgtatacaagggagctggctgctgaggtgaccacagccttctcctaataaagctgtaagtatttaaaacctgtgtcctgcctctgtgactgcttctcattcatgcatgcattcctcacatccatggaatgcccagcttcgccagccactgtgctaggagctatggagacagcagtgaccttgacaggcacagtcctggtcctgtgcagctcccaggttagctgaggaggcagagctcaagtcagcaagcagagagttgtggcagatcgtgctacaagtgaaggagacaccaactgatgctgagagtgggagcttggatgtgggcgtttgatcgcatttgaactttttcagagagaaggagctgaaaaaagaaacgaagaaaaaaaagcttgggtgtgggagagagtgatcagggaaagcccctcagaggaagggacaacgaaacagattgaagggtgagacagcagccctgttaaaaggggacgggccttgtagcagacaagcagaaggcccagtcctgggggccgctggggcggggtttcaggagtgcttgagagaagc

SEQ ID NO: 8144 - DNA, 1310 bp, Homo sapiens
gaagaagaggtgcaaattctgttcccttcctaccttgaagccttcccagaccaccacggtctctgcacaagggaggctcccattactgttctgttggcttctagacccaccatcccctctctttctgtggactctgcccgacttctggccacatgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtca

SEQ ID NO: 8145 - DNA, 1310 bp, Homo sapiens; identical to SEQ ID NO: 8144

SEQ ID NO: 8146 - DNA, 1516 bp, Homo sapiens
caaggatcagatgcaatcgtggagactgggagcttcgggcgagtggcactcgggtgtggggagcgggagggcaagagatgagtgccgggcaagatgggcaggggcccgtgccctctgcacacatatataaatataaagaacacctagataaagtctatatatctctatatctatatgaagtcatagtttgctttatttttgtacctgtgcttagagatgttttgagcagtgctaccttcccaggcagtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgcccggagctcggagtgatgtatttgaagctggtgctgggccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggcttggttgacagttttggggtattatgggaagagtaggttggggtaaagcttgagtctaactcttgatccttacatggacctatgaggccc

SEQ ID NO: 8147 - DNA, 1387 bp, Homo sapiens
gggcacagagggtgaggtcaggcatgggttaggatggtgagaccaccccaggggacaccaagcctcagcatctctttgagtcatgtgataacttagttacttgtaagggtgcagggtacacactgggggatcatcccaagatgacgaagaatgattgcctggtgggcatctggctggggagtggtagccatgcagggcatgtgggagggggatctgggcatcagggacggattgtggggtggggtcctgcatgtgaacgcagactggatcttgggagaggtcttgcttcttagctagatcttccttgcttcttctagaattagcctctaacactaagtgcccaaaccaaacatggacatcttctttatattgtatttcaacttcatttgttttgggggctcctcaggcccaaagctgagaaacttgtcttgagatgcccatcctatcaccagctcttcatcagtggagaaggaagtgccattctcattttcctaagctgcagcggtgggttgcctctccgtccacaatctgaaaatgttcatgggccttggtgatggtgatggtgatagagagggggagctggagcctgacgtgccttcatccccctttcctcttgaggtagagaggcttccttccggccatgaagttgcacagtggcttcgtgaggccttctctttactttctcttcttttgataggctaaagtcactagtctgtggtggaggtgggagggcaaaagagtttcacctgaaactcttggcttgaccagccattcttctctctttaatgtctccagctctgcttctttttagattaagaggcagaatgaaaaatctcttctttagaagaagtcagtaaaccaaggatcaaagcccagattggactttcgcactcttaccagcttgctgtttggctaggggtaccaatcaccacccttccctctgactgcgagtgaatccacactggttcagagccttatttctgggttcctgtctgtactctcaaaaccttctttcaggagcaagtataataaccccaccagatgttctgtgtgttgggttgccgagaaggtggaagtttttttcaacctcattttaagctgttagaaaaacactcagtagattgaatttggtccaaagacaccaccatcccctgagggatcccatgtaggataaggataaatgaagcatccatacaggggtcattaatggctgctcacatcttagagaaggaagagtctgggtatcttggttgccatatactctggtggaacagtggccagtcattaaaatcacatgggtgttgtcttctgcggtgtagaagacagtagtagtagttagggtttcggacgagagctggtgaaaagctaccggctttggagccctggc

SEQ ID NO: 8148 - DNA, 1101 bp, Homo sapiens
acctggatgatgggagttgccgcagctcacctcccgtccccttactctgttcctcccgcagcagcgtgggggccctaaccagcctgcccggtggctgctgggagaccggtgctgctcagcgcctaggtgtccagggtgggacatttggtgtggtcaagctgtctttggagatgcctgggtgggaggtctgggcatacgatggggggctcaggtgtagattggggctcccctgctgcttgcggtgctgcttcacgctgctgctccacgctgctgctcatctgcactgcttttccacacgtggctcctcgctgctttgttgcctgggccagggaagggcggggccgaggttggggaggtctcctttctttctgcctgcctctaactctgtgcactgactccgacgtttggcgccggcttctttttgtactgctttccgctgcctcatctcaccctcctgggcgtgcacggtagtgagccgggacccgggagtggatcctggagggcacccaccaggttacagctcagggctgcaaggagagggccagtcccacaggaccatgtctcctccctgtggtgacgtggcagcactgcacccatagccctccggctttgctgggagttgggagcctgtggaacaagggaacaccctcggcccgtcttcctactctccatgcatagcgtgaccttcttccaacccttacggccttagggatcctggccccactgtggggaaacccctggtcattatggtcttataccctggacatctcaggtgactccagtctgattggatgaatgagccctgtgggttacccgaggccctacttcagctgtccctgggggtgtgtgcagccaggtcctgggctccttccctcatcctgccactgttgagccgcttatccccataccccagagccttactctcccaaggcagagcttgttcttagggttgtgaccagggtgggattctcccacaatgcagctggtaatccatctgaccagtgtcctgagcacgacttgcacctaaaggcccctttggtagaaaagatgccagctgtggttggtgacccagcatcaggaggattggcacagccaaagctg

SEQ ID NO: 8149 - DNA, 1214 bp, Homo sapiens
ctgtctgctctcccacctggcttccctgtgtctgtctgtctgctctcccacctggcttccctgtgtctgtctgtctgtctgctctcccacctggcttccctgtgtctgtctgtctgtctgctctcccacctggcttccctgtgtctgtctctgtctgctctcccacctggcttccctgtgtctgtctgtctgtctgctctcccacctggcttccctgtgtctgtctgtctgctctctcacctggcttccctgtgtctgtctgtctgtccctgtgtctgtctgtctgtccctgtatctgtctgtctgtctgctctcccacctggcttccctgtgtctgtctgtctgtccccgtgtctgtctgtctgtccctgtgtctgtctgtctgtctgtctgctctcccacctggcttccctgtgtctgtctgtccctgtgtctgtctgtctgtccctgtgtctgtctgtctgtccctgtgtctgtctgtctgctctctcacctgcgcttcctctatgcagacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaaggtgctagagagatgcatgttgagggttggagtgagggctccccccagtactgtgatgccacctctgggctctggatttctgccaggactcctggccccttccaaaagccctgggcaaacagagagctgcttctgtaggggtctgcgggtgccgcccgccccgggctggagctcctgtactatcctgcgtgctgcctggcccagctgggacccagcctgggatggagcgcggagtctctgaccagcgttccctgccctatcgtctgtgtctggcagaacctcggttggaccctgatggaggatggctccattcgaattgaggaggccacagaggaggctcttggcacttatacctgtgtgccttacaacactctggggaccatgggccagtctgcccctgcgaggcttgtcctgaaggtgaggtcccagggctgtgacggcctccatgagctgggcacctggatccccggcctcacgagggtgcctgtgctttcctccccaggaccccccctatttcacggtgctaccaggctgggagtacaggcaggaggccggccggg

SEQ ID NO: 8150 - DNA, 1166 bp, Homo sapiens
gaccctagcatcctggaccccagcctgccttccctctgccctagagagggaagctgggtgagccagtagtcctggaaatgctgctgggatagggatattgctcagcctgaatggaggtgctcccgggtgcgctggagaccccccacccatcctcttctgttggcactttttcattctctctttcatctcttcacagctctgtatccatcatgccttacttttgtctcaggagacctccaaaagaatgagagtattctagggaactgaggctgctctcaatgccaagtgcattgagttgccttgcaggctggggcagggccagctggggcgggagagtggctctgtggccaaggtgctatgccctttcctttgccacctgctgctggaggtgggtgccagctgttattctggagccctgccatagggaatggtatgaagattatgatgagtcccctgtctttagctggggcagggggcggggagctgctgtccttacctgatggcctgtggggcttttgtctgctctattcccccaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacggtgagtgacggcttccagggtgggtccacctcaccatcaacggtgcctgagggctgtttccggggtgggcctgccccaggggaagcccttctcccaactgcatctcaccccctgcccccctccttgttgctgtggtcccatgagacatcagctcactcctgcagtgtccccgctgctgtcttctcgaagcctgtgcaggcagtgcaggtgcccaggagcggcagctccctgcatgtgtggtgctgtcagagtccttagagggacatgggaagctgctacttcaaaccaggagggctgaggctttaaggtggcaaaatgggtcaccgctgggattatttcccagccttgggaagaccctgctaccccaattctggtggagttcctggggtcccagagttagtctttctttttagatcgatgttttggttctctttaactgtattcgtttgattagtatgtaccaagggtgtagtgtgtatccag

SEQ ID NO: 8151 - DNA, 1080 bp, Homo sapiens
tagaggggtaccatcaggggctcttgcactatttttacctctaaatattacattctcagtagtgccctgcttctaaggctctgaatacaggcttaaagtcatcttatcttgctggaatttgctgtgcagagccataagcctcccattttgttagcgtcagctaggccagtaggaacagaccgggaccttgtctcacactgatgatacctcaaatgttggccggctatgtgaactgcctatttcctattgctggagttttgatttttaactaaatacaaatctgtagattctctcttctcccatcccagaaaacaaaacaaaataatgctttctgaaattgtttctgggacttaaaagtaaaaaaataatggtatatccaaaattctccatttcaaaacacaacaacagattccattaatatagactcaagatcaaaacagcacacgtgctaagctaaggtagacagtgttgactccaagtgttttgatcaataccatgacaaaccttttccctttgacacactctgaattttgtttgggaggagggtgtgtgtgtgtgtgtgtgtgtgtgtgtgtgcgcacacatgcacgcagtgtccatcagtatcagtgcctgcccaagttaggaaaattacattcctggttctgtattgaggagaaggatgtataaagcaacatgaaacattagccctcattttcttttaaattaaagactaatgttaattgttctcaaaactggatttttttccttaaaattaaaggaatctttttcttttggatttaatgaagtattgctagctgaagccagtttgacatagagagatgtcagaatgatttgaaaggtgtgcagcctgatttaaaaccaaaccctgaacccttttaaagaacaacaaaacatgttttacatgctcaaaaaaaaaaaggagggagctggcagatgggaatgataaggcaggagaggaaatgaggaaatactgactcgcttctgctcacaatggccttcctagctcacacggctcctcagattcttctctggaactactgtgttctgtttccccttccctttcctaatttggaacaa

SEQ ID NO: 8152 - DNA, 1112 bp, Homo sapiens
aggcccaagttgaatttggattcaagtggattctaaatactttgcttatcttgaagacagaagcttcataaggaataaacaagttgaatagagaaaacactgattgataataggcattttagtggtctttttaatgttttctgctgtgaaacattttgatttattgatttctttcacttttcccatcacactcacacgcacactcacatttttcatttgccataatgaaccgtccagcccctgtggagatttcctgtgagaacatgcgttttcttgtaactcacaaccctaccagtgctactctcaacgagttcccagaggaacttaagaagtatggagtgatgactttggttcgagtttgtgatgctacgtatgataaagctccagttgaaaaagaaggaatccaccttctagattggccatttgatgatggagctccaccccctaatcagatagtagatgattggttaaacctgttataaaccaaattctgtgaagagccaggtggctgtgttgcagtgccttgtgttgcgggattgggaagggcacctgtgctggttgcacttgctttgattgaatatggaatgaagtacgaagatgcagttcagtttataacacaaaaaagaaggggggccttcaattccaaacagctgctttacttggagaaatactgacctaagatgtgattacgcttcagagataccaacgggcactgctgtgttcagtagaaagaaatgtaaatgaaggctcacttgattgtggcatttagagggaacccttggtacctggaaatgtgaatctggaatcttacctgtgtcatcaaagtagtgatggattcactactcctcaaccactctcctcatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctgtctttttaaactttttcaaaataggtctctaaggaaaaccagcagaacattagcctgtgcagaaccatctgtctggggagcacactcttcat

SEQ ID NO: 8153 - DNA, 1119 bp, Homo sapiens
ccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataac

SEQ ID NO: 8154 - DNA, 1209 bp, Homo sapiens
ctgggtttattaaattgcttatttctctacttgttgtccttctgtttcaggaactctgataagactttttagaaatgagtagtttacaaggaagaaacatacactagtgactttaaatgagaaggaaaagagtagtttcagcttcaggaggataaatcttgcatatgtgggctactatagtgctttttttttaatttaaagagattcactggagaatatttgtggttagtgatcattcaaggtaaagtgtgaagacttggtcaaatcaggtactatatatataaattcatagtattttgtagatgtgtacacagagagagagacagagctggctgtcttcatgcttagccatttttagaccattgtcccttcaccagcaggaatacgaagtgtccctctgggtagccagaacgagctgacttctgttccaaggggagggtgttgaattgaggactgaaggtggagcaagagccaaggtccctcagggtcttctgtggagatttggggcttttgtcaaaagctactcaacatgtttctaattctttttccccatttagaatatatgagtagtatttgtccccaccctatcttacaaagccttcagagtgttttgaggtaatgcttacaaagtctcccagagaaaagcagaggtcctctacatccagtatcataatgaaaagcaaaaataaacttacatagtgtggtagggtggctctactcaaagaactagatcaaggagaggcctgtctttcagaagttcatacatctaaaacatgtctttgtttgtgttaccaggttcagaagaggaatttcatagaaaatattattccaattatcatctccctgaagactgtgctggagaaaaataagatcccagctttgcgggaactcatgcactatctcagggtaagggtggagcctgtgcttttgtggttgttgtcctaccagttcattacttaggatcttctgccagttatgacagtgcaggcaatccgtgaatgattagaaccccaaattctgcaaacccaacattaccttggtaactgctgtggagctaggggttggctgtgggttccaccaaagccgctctttcccttggatgtgcagccagggccgtgaagagccggcccactgtgccaagcacgtcttcccttaatggagttcaagtccatctggaaaactttcccagctggggtcaagaacacagtc

SEQ ID NO: 8155 - DNA, 2700 bp, Homo sapiens
gcctctaggaaacctgtccccatgcctccctctaaggtgtcacattgcccccctttcaattctgcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcattttgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaagttctgtggtctcttccgtcttacatggtcccaactccgacactcagggaaagacagatccctgccctgatttccctacatagtgcctgtgctctcactgtatagccccgggtgaaaaatgatgaatactttattagccacctgtttgagacaagcacatggctgagaaatgaattcagttcttatccctatctggcagtttatccagaactgctcatgggatggtttaaacctctgtgggacccagaagatgaaaggggcaggtgagcaaggctggtgtagaa

SEQ ID NO: 8156 - DNA, 1084 bp, Homo sapiens
taactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatg

SEQ ID NO: 8157 - DNA, 1115 bp, Homo sapiens
caccgtgtccaactgaggcctttagtggtcgggtgatttctctctcgtttttgctcatgtaagtgcagtggatcctggagtttgttaccaggatggggagttctattcagaactgaccaattaaaaaaaaaccaaccaggatggggagttcttttttttttttttttgagatggagtctcgctctgtcgcccaggctggagtgcagtggcgccatctcggctcactgcaagctccacctcccgggttcacgccattctcctgcctcagcctccggagtagctgggactacaggcgctcgccaccaccccctggataatttttttgtatttttagtagagacaaggtttcactgcgttagccaggatggtctcgatctcctgacctcgtgatccgcccgcctcggcctcccaaagtgctgagattacaggcgtgagccaccgcgcccggccaggatggggagttctattcagaactgaccaattaaaaaggaaaaaacataagtcctttttctcttaagcatatggttagggtaagaatactcttgtgggattcaggctgtgtggggtccagtcttggttctgtgggaactggctctgtgactttgagcaggtcagctctgcccccggacgtcagtttccttttccgtaaacacggaaggcttgacggtgtggttcctgaggtccctctgaccctgacattacggaaggcttgacggcctggttcctgaggtccccctgactgacattattcccaaagaaaatgcattggccttagcactggggattctgagttggccgtggctggagaaagactatgataaggagccctggggagatgcctgggttcctattggtgacctcgccttctcgttcaagcaggacggggagtgggacccaggcccagccttatctccgggaccgcggctgtcctcacccctcctcctgtcacctgagaataaaagggtgggctccataggcgggggctgtgaggaggggtgcaattgcatgggtcatggacgatggtccttagacatctctggggagcctttggcgggagaggcgcagggacttgggggcacttccccaggccctggtgaccgtggtcatctttgtca

SEQ ID NO: 8158 - DNA, 1172 bp, Homo sapiens
gggggaggttacttggactgctggaggggcttgctgtccctggcgcaccatttgggaggttctggtttagagaagcactgtcttctggggcctttcttgggggattagggcgtggctgggaccatctgctgggtccctcaggtgctatgcacctgccgggcatgtgatgccgtttatctcactcagtcttcacaaacccatgagagatgcagtattattccctttatgcagatgaagaaactggggttaattgaggttgagtaccttgcccagggtcacacagtaagcgatagaacctggattcaaccccagtctggagccccatggtgcgtcacacgtatgatcatcctctgtcttgtatgtcttgtttggaaagggttggaaactcttgacatgaggaatggttgttattaatagcaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacg

SEQ ID NO: 8159 - DNA, 2256 bp, Homo sapiens
aggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaag

SEQ ID NO: 8160 - DNA, 1194 bp, Homo sapiens
tgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattctttttttccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcattt

SEQ ID NO: 8161 - DNA, 2747 bp, Homo sapiens
atccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcactggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtcactgcttcaagattagccacagcccagcccaaaataatacgtctaaaaaaattattaaattggctgggcgcaatggctcatgcctataattctagtactttttactttgggaggccgaggtgggcagatcacttgaggtcagtttgagaccagcctggccaacatggagaaaccccgtctcctctactaaaaatacaaaaattagtcgggcgtcgtggtgggtgtctgtaatcccagctactcgggagcctga

SEQ ID NO: 8162 - DNA, 1100 bp, Homo sapiens
tctcctgagtagctgggattacaggtgcccaccaccacacccggctaatttttgtatttttagtagagatagggtttcaccatgttgaccaggctggtcttgaactcctgacctcaagtgatccacctcccttgacctcccaaagggctgggattacagcgtgagccaccacgcccggcccggccatcccagaggttttttttaccttagggtgatgcacactgataggatttggggtgagtttctaatgtgccctttgtgtgttgggaagttgggaagggaggatcgtcttgacaccttgaccgcaggcacatgtccaggcagcccaggtctaggaagcagcactcgcgatggattctcacccagccttctgcccgtgcccctgtagcaaggccgccaggtgggagagtccggctttgaaccctgctgcttgaggaacaggggagttgtggcacgcctgccgctctcgtgtttgagttcaaactccttttctgcccccaggatggttcatatcatgaagatgttggttatggtgttagtgagggcctcaagtccaaggctttatctttggagaaggcaaggaaggaggcggtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcctgtctgccgttttcccactttcgttagtattttttcaatgtttctgtttcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggtagcatagttaacgtagttacacagtcacgcagatgtccgtgttagtccatttatgttgctatacaggaataccagaggctgggtaatttataaataaaggaggtttgattggcttatgattctgtggac

SEQ ID NO: 8163 - DNA, 1132 bp, Homo sapiens
tgggtgagttcctcctcccaacagaccattcgttctcgcgggctccatctagaagatttttgaaataaattcattgagaattttcttgaaaaaaaaattttttttaacagactggttctcactctgtcacttaggctggagtgcagtggcacgatcctagcttactgcagccttgagctcctgggctcaagtgatcctcccacctcagcctcccgagaagaatgtttaaggacagtttatcgaaaaaagtagatgaggaataaattatgtcaattttgattcacatttaagtgtggtaaggaattaacacagcttttccttaaaaacatttgtttttctaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggtgagcaggtagggaagtaggtagctggacggggacccaggctccagagttgtgtctcagccagcgttccctagagtggtggaattcaaatactcttgctcatgtgctccctaaaagaatggaaaaactgttctcttgcacatgttcaagctgacacctaaaagttttcaccatatataaaaattgttgcaaaggatgtattttttggcatatggtaaaatctgacattttaaaatacaataattttaccatcactgataagtgtttggaaactcaactttaggcaaagcaggtccttttgttataacattgatgaaaacaaaaatatgttttgttaataagttgtttcacttcaagtcacagttatttaaggtgttaagtgagcacttaccgtaaatctgttgaatctt

SEQ ID NO: 8164 - DNA, 1197 bp, Homo sapiens
gccgtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggtgaggcttcgcgaccccctccccctcctcggcagcccggggggtggggaggggcgggccccacccagaccaccggcgcccacccgcgggctccacccagccgggctccgggatcgggcgggagccgaggcggtagatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttaggtgagtgatgtaaaatgctgaagatgattcttttcttttcgatgaaatggtgagataaaagatgaagtgtatttcaaaaggacgatgagctgtgcatgttgcctttgaggcagttgcagaacctattttattgcactagatctcacgtttctactttagggttcgattctttttcttctggcggggtgggtggggggtcggagagggaagagaatccccttactttggctcaggtaaattgtgagcgtggatgtatctgaaagttttacaccgaagaagagggagatcttcggtttagacaacttcgttccggcagccaccatttgggtcgcattacgcttagctccttcaaggtggtgtcttccagttttttttccccccaatgcctaaaagatctctttataccacccttttacaggctttatcctggccccttgagagaaggccccaaactcaggtggttgctttggaaggcacattgctgaataatagttgcaggtggttgtggttgactgctttgggtggataaagtgaacaattggaatagttctgttggagctaattatatgaaaaatgcttaaatgttttaaagtacaaccgtcttttatagcgtgttgcttgctcagtacaccttga

SEQ ID NO: 8165 - DNA, 1151 bp, Homo sapiens
cttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctcccattcttgcttggttcttttctctggtttctctttctcttcgtgtctttcctttcagcatatgttatcttttttttttttttccaattcttctgagagtataattttgccacactctctaatatctattaccaaatgtattttagagtaggtaacttaaatgtaaggtatac

SEQ ID NO: 8166 - DNA, 1234 bp, Homo sapiens
ttccagcccctaaactaatcagtccgggcattagagagctttgaaatgtttattaagaaaacagtcctgttttgacagacaggagttagagcacctggacttaaagcaggctttacagctctactggggatctctcatgtaggcaacatgaggccagcagagccctgtgcaaacaggcatcataagcaaatgaccatttcttttccattatagacttcatccttcaaaagggagtgccattcgtcccaactagtattttccccccttttatctgtgtcactaatgctaaattagttcatgggtcattcaaattctagcagctttggtgttagtctttatatttcagttccagtgctccgctgattattttggcatgaaactatcccatacagtcatcatgctgcttttaattcaaaagattcctatgagctgcaccaggaatatcgtatctagtacaaaaactgtatgtctgttcttccctgaagcagattctcttgtaacttgagtttagttatcttagtattgatattgagttatttttagagagttctgtggtggttagtggctcggtgttttcatcagtcgttcacttaactatcctttcggaacatctgtgccacttacgctgtctcacttctcacccaagtcttagatgctttttcattcttcatattactaggaaagattaaacacatcatataatgccagtgactgcaggactttcctttaaagcttctaaactacctgccagtatgctgaaataaggtatattctgaagcttatcgtttaaattgtagatttcatatgtaaaaacattttttttttttaagacagtcttgctctgtcacccaggctggagtgcagtggcgcgatctccgctcactgtaagctccgcctttcaggttcacaccattctcctgcctcagtgtcccgtgtagctgggactacaggcacccaccactgcacccggctaattttttgtatttttagtagagacggggtttcaccgtgttagccaggatggtctcgatctcctgacctcgtgatccccccacttcggcctcccaaagtgctgggattacaggcgtgagccaccgcgcccagcctgtaaaaacattttcatctttgtttataaataaaacatctgattatacaacaatacttttatgggactcaaagaggggagtcagggttggggtggggtctgtcatttatttacttatttttaaaagat

SEQ ID NO: 8167 - DNA, 1179 bp, Homo sapiens
gatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactgga

SEQ ID NO: 8168 - DNA, 1099 bp, Homo sapiens
attcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttat

SEQ ID NO: 8169 - DNA, 1657 bp, Homo sapiens
tcccggcttccagcccattctctttgcagctggggttcctaccctaccctactcccagctccttttccccgcggatggagagatggactctgctgcttacccacccactcccctgcagggggtggaggactgattcagctactgtatccccactgctgtgactggaaatgggggtggggagtgactggtcttttcaaccctggggagttgaggaaaatgtctgctttcacttcagctttcatttgaatactgtgatctggtttttattttgaaatgtataaaaagcaaacccagctacaaaggccttttcacccttccactttgtaactaatcccagtctcttctcatcactcctcctcttacagtactctgctattcatgctcatttcatgttcttaatcttctttcctgtttaaaaatttttttttggaaaaaatttgaaatcatggtccttttttctgctgaatatattctatatattatatatatataaattatatatatatatatatacatatatatgtctggctacctcgttttagtttactttttttctgaagccctggaattctacaagagagatattttgagactgaaacatgtttgtgcctagactggaaagatgcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgtttttgaaaaaaaaaaaaaaaacaacagccttgtatctgcgaattatttttaaggcattgtgtgcttgggtacatgccaaggtaggaggtgttgtttgtatactctaagaggacgcaaggtggagtttggtgcatcctatgtgggggtgagtcaactcatgggtagaattttattctgtataaggtttactactgacatgttttgtttctagaaatgtgattagactggagatttatataatgtttggctttaaactttcaacaacgtggaaatttaaagaaattgaacaaaatgaaactttttaaaaaaccagatttgtatg

SEQ ID NO: 8170 - DNA, 1125 bp, Homo sapiens
cggcaggaaggaaggacggacggaccaggaggaggagcggcggcggcggccggagccggaaggcggggaggggccggccgttgggcccgaggcggcggcggcggcggcggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggc

SEQ ID NO: 8171 - DNA, 2549 bp, Homo sapiens
taatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgacctgtcgtgtgtttttttattgccgttcagcttacctccccttggcttttggcacttctctgaagctctaatttagacactgtgatttaagaaatttttggaaacttccccttcgggatgcagaaatcaaagtgcttatgcccaactcctgtttcctaactcaagctttcctcgtaagttgcaccaggtttagaatggaggggagagcagctctaaggggcagttcttatttattattgaagtttataaaaatagtctctaatgccaagggcaataggctctaccataaagcctgggtgtgtagtaggctgtaccatctaggttt

SEQ ID NO: 8172 - DNA, 1230 bp, Homo sapiens
cagccttcaggggcttcactggaaacctccagggcagctcgtaccagcggcagccccttgcccaatcccatccccactggtgggtgggttctcccagctgctgcagaggggagtccagagccttgagactccgggtccctccctctctggagcagccaggcatgaagaaggtcctcaggtgctcctggctcccagcagggctgtgcctacccgaaagaaggcagcccgccttcccaggccctgcacttccctgacctggctgtggaggctgctctctgggaggagtgggtgctaaggggcttctccacccacccctccttcttgcctacagagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtaagtgggaggctggccaccccaggcggcacacagggcccacgtgctgcaaccctcaggagacagtggaggagacggaggcctcggccagccacttgtccctcaagcttccaggaggttgctgccccagactccagcaagagcaggaggcactatgctgtctcccaagtcctgcccttgatcagacctggcaggctcagggcaagtcagcagtggcctgcggcgctggttctcccacagggccctctcctctcccacacttcctgagtggcagaatgtgatcatcagatgtttgtgttccggcttcacaacagaaaccatcccgtctgcccttccccgagtctctgcccaaacctggcctttctcccagccgagatgggaatggtgtttccattgcttccctggagcccctttgccagcctcccggagagggcatcccctgtgggaggcgccatctgtagcactggcccattctgcccagcacaggatcattcctggaggtcttgactgtacctcttactcctgactcactcttttctccttgtc

SEQ ID NO: 8173 - DNA, 1649 bp, Homo sapiens
aagtgttctgttttgttttgtttgagacagtgtctcttgccctgccgcccaggctggagtgcagtggcacagtctcagttcactgtaacctctgcctccagggctcaagtgatcctcttgtctcagcctcccgagtagctgggactacaggtgcatgccaccacgcccaggtaatttttgtaatttttgttgagatgaggtttcaccatgttgcccaggctgatctcaaacttctgggctcaagcaatctgaccacctcagcctcccaaagtgctgggattacaggcataagccaccaggcttggcctatacaggtatagctttaggacagatgtaggagaatgggtgtatctgtgtaattctgctggaaattaagtgtgtgttttttcacttgggaagtcagcccgtttgctgttcatcttccttgcaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaccctttctgttcagccttggagtggtgggtatgggtgggtacataatgggtagtagcacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacacttaggaagacgaaagtataaagatctagaagactgggacaccatgcatgttcattttgaagttggaattggtcttctgcctacctctgatctggcagaggtatctgcattttggtttgttaacaaggtaaaa

SEQ ID NO: 8174 - DNA, 1608 bp, Homo sapiens
cccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgctgggctctgtggtttattggcgtctgattcctaaggcaccaggagaggctggaaaagaaagagggtgttgatggagacgatggtgatagggaagaggcaaggcctgaagttcacccaaagcagcagttggagcacttgcacaggcacacacttgacaacacaaattgccagttttcccagtgctagtcctgcacagctcacctcttttccctggcgtctctgaccttgttccttgggacctttggacctgctggttaacttaggccttttgagggttcttaataagacaagctcacgaggggtagggccccctgaacattagggcaggaagggcccagttacaggtgcttcattcccactgccatccccaccctgaggcctgggagccagcctgccctgcttttcttctgcccggcagcagctcctgttacagttttttgcagtcagaacttgaagaaagtgctatcccctgcctgtctaacctgaaaagtagccaggggcccaagggtcacaagaggctccagggacaggtgagggcctcttctctgcatcaccactcaagcagcatcaccatagcaaccccaggagtaaacaatggtgccagaaagggcttccccacaaagccgcccctcctggctctgaggcccagaagaatgg

SEQ ID NO: 8175 - DNA, 1191 bp, Homo sapiens
ggaagtcaggtgcctgagagcagccacagggtttagctgagatcttggcccaagtctgttttcacacactgcccttgggaaggcagtcaggtagcagaggtcctgctttaaaggctgttcactctgcatttttatcctatctccagcttcgaagcccgctggcctggtacatagattttgcgtatgttgcttcactcattcaataattcctaagtgcactccccatctgaccccattcaaagcaagagaaataggtctcgctcgcacccttagggaacttgcagtctgaaatgaccgtgggctcacccattcaattatattcaatcaactttatgcaagcctgcaaactcagatgagcgataacagcccagggttgtgggcccatcagcgtgttcctcccttcctccctctcttccttccctcccttttcctcagcgtcctgctttcattgttttgcagcaggttgaccagcatagaacatgatgcacatgttcagccgtgcaaaagaggagctagtgcttaagtacaaatgggagacatgattcttttgttttaagtaaatacttagcctgacttcggtcctgtgagcatctgcactccaggcctgagcagctgagctgcctctcacatggacctgccatgattccatgactgcctgcatgcccagtcatcactacatggcattagggtgccagtggttgaacgtgatcacagtgagccccttttctagcgacttctccagccccctacagacatgatctagctaggacagagacaactggaatttctcaaagggcagtggtctgtaacagttaagcattctacatggttctcttggttccctagatcttccatttttcaaggaaaatttgaacttctgatttttgggtaaaatctcctaatttttaactattggcagctaattaaaaaaaaattaaaacgtgatgcggaccaaataaaacctgtgcgtgggctggatttggtctgggggtaccagcttgtgacccctgctttatgtattaaaggtagggtgttatgctgggcactttggggaatataaagagcataaagtgatgaaattaataaaaatcatggggtgtgggagaggcagctcacacacagagcataacacagttggctacgcaagtgaaaccgaaggcgggctgttccgggaatgctgggcagagactg

SEQ ID NO: 8176 - DNA, 1184 bp, Homo sapiens
taccatgttcatgaatagaaatagataagtagaatactattcatattcatgaatagaaatataaagataagccggtcatggtggctcacgcctgtaatcccagcactttgggaggccgaggctggcagatcacgaggtcagaagttcgagaccagcctgggcaacatagcgaagccccatctctactaaaaatacaaaaattagccaggcatggtggcacacacctgtaatcccagctactcgggaggctgaggcataagaattgcttgaacctgggaggcagaggttccgatgagctgagatcatgccactgcactccagcctgggtgacggagaaagattatatctcaaaaaataaaagaaagaaatacaaagacagcaattttgctttccggtggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacagtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaagacagcaattttccctaagatgatgaatgaattcaatgaaaggtcaaccaaaatatcaaaagggtttgggggaagaggctggctgactgatttttggtgaaacaagacaaactaattctgaaatgtatgcaaaagaacaaagggccaagaacagcaaaaatactcttgaaaaagcgtaagaggaaaggatttgccctaccagatattgagacttattataaagttgtagtaatgaagacagtgcggcatcaggatagacaaacagtccagtggaaaagacccaggcatacacagaaacacaggtggcggtacaggtctgtggggaaaggtggactagttaatcaatggagctatggaggaaaaatcagagccctatcttatatacaaatataaattccaaatatactaaggacttaaatataaaaagaaaagcttcca

SEQ ID NO: 8177 - DNA, 3760 bp, Homo sapiens
ggtctaacagccccacgaggctgagccagagttcacctgtgtgtgtctccagggtgacctctgttcacggttttcttcatgtcttcattccataagcattttcctggcacaccagtggccatccccgcttgctctaggtgccctgtgacatcccaagcctctcggggctgaggtcaggtccaggctgctgcagctcctgcctcaggcccctccccgtgtctttcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagcacagcaggctgtctctcagt

SEQ ID NO: 8178 - DNA, 1405 bp, Homo sapiens
atttatatctaaatgctattacattttagtactaattttcctatatctagacattgattaagatatatctgaattttctttcttattccttatatttaggcattgaaaaacatggcagtagtaaaatagaaacaatgaataagtctcctcatatctctaattgcagtgtagccagtgattatttaggtaagttttttatattaataatttttctcatcaacaatgctgtttctctgacttttgtttaaattgctgaaattgtggctagaagcaagttctttaaatttgtcaagactctcttgatgtcatggcctttatttctttgtgttttagtctcattctgtcgtactgcagacacacattcttccctgaagggtcataactacccgtggcttctagttggagcaactgacctttgaagaaaggggctgcatattcccaattctagtttgaaaattttgggggaaagattatctctgtttgggtcttggatttatccctaaaactagaggtgttcccagggcactgatgtaccatggttgacccagattgggctaatagtctattactggaagcatgggagggatgaacctgggcaaataaaaacaatagctgtaatagagtctggtctgcagttcttgaaatatcagttgtcacagaaagttttccattgatttttatgcctctcctgaagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtaggttttattctacttcgaaattaattctatgggaattcagtcaaaaaagttcttggaagctattaattgtgcaaagcactgtgttaaacctttggggtgtgcaaacttcagggacacacagaacagttcaattcagtgatagcatttggggaaaaagttttttctacgagttaacctttaagctatgccttgaaaaatgagtagcgtttcaacaaactaaaggtgtaaagtagcatttctgactaacagaaaggcattacctgtggaatagacaaatgctctatttgtctctaactgaggcttgctgggatgaacatggaagaggctcgagagggaggctggtactaatcagggagggtctcagacccactggaagaagtgtaggcttttttttcctggaggtagtagaaatccatgaattattctgaggcagaagtgatatgaaatctatattttattatgatggtttttagactcatttagaaattgggcaaatggaaagtgtagtgaccttgacagaacattataacatattaattaaaaatttaaattcataaa

SEQ ID NO: 8179 - DNA, 1692 bp, Homo sapiens
aaatgcatttgctttttctattactttagaaattataattatatgcatttttgtatgcctttacaactagcattatttgttcccagccttcctttttcagctttcatggtgaggttttagtgtcattaccttggcttctgggatgtttggaaataggcaatactgtattaatttctgctctttagaacattctgttcttttgatctagtttattgcttgatagacactggaaagcagaataatgcttaactaccttttttttgctgcttattttataaattaatctttgttaagagatttctgacatcatcagcatcacatcatatgtttcctttcagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtctattgctgttgtacacttcttttatctaacgtatatttttatagtgtcatataccagccccctaacctgccccacctgtcccctttttaaaaacatattttccagttacatagcactgaggtactctatttggtgtagatcaacaataaacataagagcctactg

SEQ ID NO: 8180 - DNA, 1130 bp, Homo sapiens
ttcattgaagagtctgaaattagggacttatttcaaatgtgaacatggctaatcgaggcgcaagcaagaccctatggctcaaatactggaaataaaatatgccagttcaatatgccagtatttctgggagagtctgctgttggcaaatcaagcctagtgcttcgttttgtgaaaggcccatttcatgaatttcaagagagtaccattggggtaactctcaaagtgataaaagctgtttctttgtgaaatatgggcccaaaaagaaaaccaactgctagtgttggtgatggaagtgaagaaaaaatggagagatctaagagtggtggttcttagccagaaaatagacgttttggataaattaaagtggttttacagattcagctgattttctaacccaaaatgtgtgtcttgatgacactacagtatagtttgaaatacaggatacagctggtcaagaatgataccgtagcctagcaccaatgtactacagaggagcacaagcagccatagctgtatatgataccacaaatgaggagtcctttgcaagagcaaaaaattgggttaaagaacttcagaggcaagcatgtcctgatattgtaatagctttatcaggaaacaaggctgacctagcaaataaaagagcagtagatttccaggaagcacagtcctatgcagatgacaatagtttattattcatgaagacatcagctaaacatcagtgaatgtaaatgaaatgttcgtggcaatagctaaaaaattgccaaagaatgaaccacaaaatccagaagcaaattctgccagaaaaagaggagtagcccttactgaacccacacaaccaaacaggagtcagtgttgtagtaactcaacctccagtttgcactagctagaatagtcttctgcttcttaaatgttaataacaatggaattggaccatttaaccagcccagtatgacttccaaaagagacttatgatagagtcaagtttctaatgcagaattattttaagtgttttgaacttaatttttaataacatgcatgggtccctcttactaatgtttcagcaatagggaaaaatgagaactgtgtgtatacttgtttcattggaaggttagggggaataatttctcatc

SEQ ID NO: 8181 - DNA, 1237 bp, Homo sapiens
acctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggtttttgttttgtttaattattttgagagctatttggtttgcaaatgtctttcaactcctattaactccacctgcatttttttttttttttaagacggagtttcgctcttgttgcccaggctggagtgcaatggcccgatcttggctcaccacagcctccacctcctgggttcaaacaattctcctgcctcagcttcctgagtagctgggattacaggcatgcaccaccacacccggctaattttgtatttttagtagagacggggtttctccgtgttggtcaggctggtctcgaactcccaacctcagttgatccgcccgcctcagcctcccaaagtgctgggattacaggcgtgagccaccgtgcccggccccacctgcatttatatgagaagtagattgggaggtt

SEQ ID NO: 8182 - DNA, 1210 bp, Homo sapiens
ggctgatttgctagtcccttgtaatttgtctgaaaaactcccacagtagggcaggacaacgggggaggaacccgggcatctgccagccggttctcctcggtctcagagctgcttctgcggccttgcagtccccgcgccctgccctctccatgactgcccgtcctgggcccctcgctttccagatcccgcacccagctgtcccttgcgctctctggaactccctctgctctccctgcgaggcttgtccaagggctgaccccgggcccgccgcccttccctcggctgggccagggctgtccgcagtccgctctcccgatcgggcttccgaagaagggaggaggccggttccggccccgcggccctcacgtgctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgaggaaggggcctggtaggagtgggcgagggtgggcaagagggatctgggcagccgtcgctccattccctctgccctcccaagctgacccctgactaattcttctctcctcttctccatctccctttgaaggtgcctccatatgcgtcggagaaccagacctgcagggaccaggaaaaggaatactatgagccccagcaccgcatctgctgctcccgctgcccgccaggtgagaggcaatggcaggacgaacctgggcctcggaagtgggtcacgggggctccagccccctcgcggcctcagagggaaggtgggcactgtcccccaggaaaactggctgctggagacgagcgtgggaaaccctggacatcacgtggaggagatgggactggccctccccactgggcctcctctttcct

SEQ ID NO: 8183 - DNA, 1154 bp, Homo sapiens
tcgtgatccacctgcctcggcctcccaaagtgctgggattacaggcatgagccaccacacccggccaactctatcatatttttatgatatatttaggttctttgtcagcatcacaactggttgaaagttggtaatcttgaaggaaggagtacctaactggggtcagcaaagcaaagcaacttgttatagaaagtaatggctagaataaagaaaaccctgactttgggagcagtagggatagaatgaatgaggcagggctctgatacaattggattcagacagctgctttcatcatctcaaactcttcctttctcagtttggttactggctgttgctaccgccttctggagaatcccaccattaatcaccagaagaaccgccccactcgggaagccataacacacctgcttggtgtagccttgacccgttataaccatatgctcagtaagttaccagtcgctttgccccgccttttttgtattgcccataatttctcatgtttaatgcttccacaggtgctacagtgaagatcatccagatgctgcagcactttgaacacctggcacctgtactggttgcagccgtgagtctatgggcaactgactatggaatgaagagcatagtgggagagattgtaaggtgactcttccttctcgaagtttctcatgcttattttccttggggagggaataaagaaagattggaaatacattatctgtgcaacagtagattccttcagatattagatacctgtcttaccttcccttactgggaactgaataattgatctatgttgctatggctgtgttttcttccctgtgtagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaagtaggtggtccactaggggtcactgagctttttctggggattttaagtccagtgttgaaaggctgtttcttaacagaacaagaaagtagctttgacaagttgtctagatttatcattgtgacatttcctttctgtagagaagcaggtcaagtttgttgaataaggagctctttattaatctg

SEQ ID NO: 8184 - DNA, 1066 bp, Homo sapiens
tgtggcttccttcccctagaggaaagccagaaattgtgggaagcaatttagacacactggtgagcatagggctggatgagaagtttccacaggactacaggctggcccagcaggtgtgccatgccattgccaacatctcggacaggagaaaggtatgtgggggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagaattgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcag

SEQ ID NO: 8185 - DNA, 1128 bp, Homo sapiens
gtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaacgcaatctataatctccttccagatatcatcagccgcctgtcagaccccgagctgggggtggaggaagagcctttccacaccatcatgaagtattgctccccgggccctggggcacattttccacatagcacgggcttaggaatcagacacacctgtatttgaattccacctcggctactctttagctgtacagccttcggcaataacttagcctctctttgtgcctatttcctcttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccct

SEQ ID NO: 8186 - DNA, 1694 bp, Homo sapiens
catcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggt

SEQ ID NO: 8187 - DNA, 1127 bp, Homo sapiens
ggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctg

SEQ ID NO: 8188 - DNA, 1226 bp, Homo sapiens
ctggaattacaggtgtgagccaccacgcctggcctataggcagtgatcttttaatacaaggttcaactaggacttgagtaaaggccaagttatattaagtaatgggaatttaggtaatctgctcttaggcactgacctaattgtgtggagctcctgcccaggaaatggcaattctcatattttaatatgagaatattaaaatatggtgataaggcccattttctgacaccatctgtttaattttaaccccaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactgagtatttttgagggaactgggtgctgcctttgccgctttaagggtaaagatgggaggtgggactgggatcttctgaggagagggaatggttgggtgctactgagaaataaggtcagttttaggctcctgcatccttgggttttcccaggaagggaaagccctggagtcagagctaggggtgattgaactccgggg

SEQ ID NO: 8189 - DNA, 1437 bp, Homo sapiens
cagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtaggaccattttcttcttgacaccacctcttcctgcagaaccattctggagcttgtaactttgctgtatgtccctagctttacatactgggtgggtggcctatcagtgaattcccttgagattgggtggattcctatcatctggaattctgactcctcgggtctccttctctaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtattttagtgctctggttcagtgtgggtgtaggtgcaggtggatgagtgtgtgcggcaggagcctggcacctgtatagttgaaaattaagggctacgtggtgtcctgataccccactgagtaactgggttctgtgtgtgggtgcagtatgtgccttgccaacgttgacttccacctgtggaaaatgagaggctgcaaaactgcgggcaccgccgcttaatggctctgtgaccttgagcaagttgtttaactttggtgggatgcagatatctcatgtatacctcatacggttgtcaagttaaaccagtgaagtacatggaacggttttaacacctaaccactaccttaatgttagtttctaggaaggctgaggggggttttcttgctaagttgtgcaaaattgggatgcaatttgtggaagaacacagcctcaatcccacacccccggaggcccgacctaacgtcctccaaccttgaaacccttgtagttc

SEQ ID NO: 8190 - DNA, 1140 bp, Homo sapiens
gagaaggggtgtaggtggatggattcttgtagcatacagtgttctgggtaagggcgatggtgctgggctttggctggagctgacatttttcttccccatattctgtagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactggtatggaaatgaggggcccaccagggttagaaggatctgatgtgaaattggggttcttgtcagaaaccacggtacagggactttacctctttacctctgtttgatgagggaatgccaaactgatagtgggttctgtggagaaagccagaagcaaattatatgaaatggatccaggggtaggggatggtgggggacaagaataagtagctttttcaattctcacagatgtttgcttccccccacccccaaccttccctaaattcctcctcagagttgcactccctttggcagaatgaagagcgggcagccacagttaccaagaagacttatgagatctggcatcgacggcatgactactggctgctagccggcattataaagtatcctttgcctgaatctgtactgaggcttttggtgaaaggttctgaaggtcttttagtttgaggttcttactttccttgttttgtttttcctgagcacttttccaatagccatggctatgcccggtggcaagacatccagaatgacccacgctatgccatcctcaatgagcctttcaagggtgaaatgaaccgtggcaatttcttagagatcaagaataaatttctagctcgaaggtttaaggtgagcggttggggaggaatatattgcttaagtgacaaacttgaaagtgcgtaacgtcctgcagcagagggagtctgtccatccagcgcactgttctcactttcttcattctatggaaggctttgctcccaagtaacttacacattagggttgaagacacacagaattgaaagttaactaactgtacatgagctgtaggtgactatgtgtccaatcagtgacacactagtgcagaggggtttgtttggggaacactgcagattggagtat

SEQ ID NO: 8191 - DNA, 1194 bp, Homo sapiens
ctgcagacagttggtaagcttttatgaagtttatgaagaatagaaaggcttatagtcatcctctccttccttctctcttatgaaaatcttttacagtacttcagaagtttctccattctgccttgctaaggctctgacctcttttctttttgctatctttcaattgtatatgcatcagtgcaaggggttagaagaaagcattctgtctcttcatccttacctgtgataatagctctatcccatgtttttcttgagttatgctgactgctaatctatatgtaattatgaggagctgtgtactctcaatcaaatttcttctaagttcttaggtccaaacaggcacaccaagtatttaagagtccagtcatgaaaaggagctagcagagtgggaactgtgaggaccaggggtagctggtggtgctgacttcagcactcctgagtcctggccctccctctgtcccaggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccccgctcatctgccctctctccctccagattggcaggacgaccagtccgacaaccagtccgattactcagtggcttcagaggaaggtgatgaagactttgatgaacgttcagaaggtgagggctgtgctttttttgttgcttttctaaatgttgctttgtttaatatcctacctgtgtcactcattcatctttttcttcttgcagctccccgtaggcccagtcgtaagggcctgcggaatgataaagataagccattgcctcctctgttggcccgtgttggtgggaatattgaagtaagtgccatacgattctaaggaggggtgagtgtcagatattgcatctttggtggaatgcgacctgctgcctctcacctgggtttcttcttcccctaggtacttggttttaatgctcgtcagcgaaaagcctttcttaatgcaattatgcgatatggtatgccacctcaggatgcttttactacccagtggcttgtaag

SEQ ID NO: 8192 - DNA, 1202 bp, Homo sapiens
cactgcccccggcttaattttttaaactacatttatgaattggaatttaggagacacttctaatggtgtttttggttcttttattagcaccgggtgctcagcagttctgcttcttgctttccactcgagctgggggccttggaatcaatctggccactgctgacacagttattatctatgactctgactggaacccccataatgacattcaggtgagcagaggcagcaggcagccttaataagtaacatgttatgctagaaaggcatagtggcctctatgagggctccaccatctggaattaggtttttaagtgagaaacaacagattctttttgtgttgtttaccttattgtaagccagagtttggttagctgtgatcctattttgggtaacatgataatagagggtggtgtctggaggcaggggtgcaaaaggaagtttcctatgaatgtaggctgtggaccttgccttgtactgaatttagaatattatgtggaagtcaggataagagtggcaccaggaaaatacaatttctggctttatttcctgttcaactccaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggtgaggtagtcaggaacttacgttttggtgtggggcttggcctctctaaaggttagggagaatctttgataccaagggtcttgtgggacttgctttttccactgcagctgctgaaactgactttggggatgtgggcccttgattttttataggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggtgagtatgaatccaaggcaatcctgtgcttggtaattggtctgaaaattggcattgagaccaaggtggtatttga

SEQ ID NO: 8193 - DNA, 1129 bp, Homo sapiens
cgtggatgaagcccatcggctgaagaacaatcagtctaaggtgagggctgagggagggatgttggagcccccactttgggttttttctagtactaccaattcattaaggggaaaacttgtagatggagaggagaggggaaaattgtctctgccttccttccttgtatgtgacagcccttggtggccaggcctttaaaaagaatgtgaggagtgggatgcttaactattgggcagtgaaaaacttgaaattttgtagagatttgctagagctctgttttcattggatttcacctttctccatctgcttcaccagttcttccgggtattgaatggttactcactccagcacaagctgttgctgactgggacaccattacaaaacaatctggaagagttgtttcatctgctcaactttctcacccccgagaggttccagtaagtatgtgtttatctgtaatcggctcataattgtgcctctcattcttcctgttgcccatttcctgtatcacttttctttcttcctttctccttctccaataacttttttcctttttctttctgaagcaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagtgagttgggagggacagaagcagactccatttagacatctgccagtctgcagagtgtttcctattcctcccccactcagcttcaaggcatctggtgacaggagcaagcaaggcctgaagaaacctgatgctagggcgctggagcgcatagttcttacttattttaggttatacctttccttatttaaaatggtggtggtggtagtgcttgtgcgttaggtgtccttagttccaaagtgggatgtgttggaagaaagatctcagttgttggcactgcattattagtcattgaaaggctctcaagtctaacctgtctttctaccttgcccatgtaggaaatactacaagtacatcctcactcgaaattttgaagcactcaatgcccgaggtg

SEQ ID NO: 8194 - DNA, 1103 bp, Homo sapiens
cactgctccaggtctgaaatgagatctgaatcgtcctttgatgaagttgagactgtgggctgtcccttctcctcccatggttatgatttgagattaagttgtctctttttctctcagtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcaggtaagtttaggatagtctggagatgtaggggctacgatgaagaggatagtgacaaaagagccttgtggatagaaggaatgaacacagcttcttggtggctgattttctctttccgctcaaagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacaggtaccagctgagcacacgggagacgggcagtctccgtgggagagtcctgctaaagagattgggaaaatggctgtcaccagtaacttagacttggaagacactggttttttttgtttgttttttgtttttgagacagagtctcactctgtgcccaggctggagtgcagtggcgtgatctcggctcactgcaacctctgcctcccagattcaagtgattatcctgcctcagcctcctgagaagctgggactacaggcgcaagccaccatgcccagctaattttttgtatttttagtagagacagggttttcattctgctggccaggctggtcttgaactcctgacctcaggtgatctgcctgccttggcctccctaagtgctaggattaacaggcgtgagccaccacgctcagccttatatatttattttgagacaaattttagctgtgttgccca

SEQ ID NO: 8195 - DNA, 2120 bp, Homo sapiens
attgatcttttccctgcctaccactctttgccaaatatatgtagaaaatgaagaggacccagaagaggatttgtcagaaacagagactccaaagctcaagaagaagaaaaagcctaagaaacctcgggaccctaaaatccctaagagcaagcgccaaaaaaaggaggtgagtgggtgactgaatgttacggggaatcagaggaagaagggaggagctctgagaagggttgaagggctgagggcatttgtttctttctcagaagtggtgggccatgttctggggatgagcctcagggctgtcctgaggtcagcatgtgtgtagcatgtgtgtgtctgtctccctcttccccccttgccctgctccagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggtgcctggacctccatcctcttctttgtactgttaaacttttgtctttttgtttcctagacaccttactgccctttagaacactttctcttcttttcctcttaactctgttactctgatttttccacacaaatttgcttagcaagtgtgggcactaggtggcaggtacttacttgactttgctctttctgcaggagcctaaatcatctgctcagctcctggaagactggggcatggaagacattgaccacgtgttctcagaggaggattatcgaaccctcaccaactacaaggccttcagccagtttgtcaggtaaaacagaaggggtttggggaagggggaggagaatctttctgttctctcttcttacttctctttctttttttattcttaaacctttccctctgctcttgtgcatttctccaccagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtgaaatggggttcaaatgggagtgggggtgtctagtgtgggcttaagatgtcaaagacagcatgggaatgctggtctgtcagccctaaggtaggagataggagggaggaatgagtcttggattttggagggaaatttgggaatctgaatgtggggaagcaagcttaggtggagaagattttattttccccatctttggtcttgtggtatatatttggatatatcctgattttaggtcccaatgctcggaggaagcccaagggcagccctcgtgtacctgatgccaagaagcctaaacccaagaaagtagctcccctgaaaatcaagctgggaggttttggttccaagcgtaagagatcctcggtgagagcccagcccatcgctttagggagggtgccatgtctaatagaaaggatgtgaccttctatcagaacctgtccttcatagtaggcacgtaagaatgtggggcgtttcccacagaacaagatgagactaggctccctgtataacggtgcttgctgggattctggtgtccccagtgagagagtactcccctctctgccactctgtccttccccttggcttgaacgtctaaccttattctttttcatcctgccagagtgaggatgatgacttagatgtggaatctgacttcgatgatgccagtatcaatagctattctgtttctgatggttccaccagccgtagtagccgcagccgcaagaaactccgaaccactaaaaagaaaaagaaaggtgtgtttctcttctgtatatttgtgatgggatgaggtgggagtgattggggaagaatctccctaaggagataggggtcggggggtggggggaggtagtttttttccaataa

SEQ ID NO: 8196 - DNA, 1234 bp, Homo sapiens
cctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagatactcgagtcccctggttctgccttctgacccccgtagagaggaggagaggggtgggcagctaggaggaggcacaggatgaggtggggaccccctctagacctaagtcacctgccctcctctgacctggagctgggggccaactggggctttaacttgggacaaaatggaagggagccatcctgacgaggagcagtggtacaaga

SEQ ID NO: 8197 - DNA, 1142 bp, Homo sapiens
tgctaaagtaaaggtgagtggcagtcccccagtcctacggtctagagcatccttttgtatgtccttgggagtccacactaggacagcccttgtctagaccgtggctgcttcctgccctcccctcctccaaggtctgtatataaactccattagcaactgtttaggctgatagtattcttagttttctgtgttgtttttattttttaatcaacttaagttctaaataaacatcttctgtggttttggtcaaaatagcaactaggatgttgttcaggtgtcgttcaacaataccttcttccccactgctggaaacagggctctcctgatgaagtgctaggcttctctttgttaggataaaacatatatattctagaagtatctctgtattcctgttaggctgttttttgtctaatatcaccacccacctccccagcctgcccagtctgcaacctcgcaatagttacttgactctcagttgtccttgggatttaatttaaaccaggctctctattgagagatacctccaaaggaatgcccgttgcaggtaggcagagtataaatgataaacagtaactccacacctctcccacttctgcttactcccctgtatcaagctgatcttgactaaggactgggtgataccctgagctgtggctaaaggagtgacacccaggcagatgtcattttctccttctgtggtgtgtcaggggtgagggtgttaggggagcattttgtattttatttaagattgtccttctaatgatgctgtttttgaagtgggaatacttttatttattttgctttagaaccagcctcttagaggaagtgatttaggaatgggagtggagggcaggtgggctagggcagggggaaaaggagggaagatttttggaagcccttctctactacggagcgtcacaaatcctggcctgatctccgcggccccagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccct

SEQ ID NO: 8198 - DNA, 1501 bp, Homo sapiens
tcatcctggtaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggtgagccagggtagcaggaactgctcacttgcagggtgccctgcttttaccccagggacctcactgtcctcatttccttcagttatttgcatgggagtagggagtgggggagcctccaggggttaggggattccctgcattctctctctctctctctttctctctcttctccttgccaggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaactaccctgaactgggtatcttctgtgtttgatatttgtggatgggaagaagactcattcccaattcactcaagcacagtgctggaaaatgaagagacccagatactatttgctgagtccctggctgaggcctagatcccaagctgtatggctttggacaggttgctcagcatccattcagaagtaatggatatggctgggtgcagtggctcacgaccgtaatcccagcatgttgggaggccagggcgggcgtatcacttgaggtcaggagtgtgagaccaacctggccaaca

SEQ ID NO: 8199 - DNA, 1585 bp, Homo sapiens
taatcccattctgatttcttcctccagtaggccaccttacgcctaccggtggcttcctgggaccgtgcagaaaccaaaagagctaagggaattgccaccccacccatccctgcacgcacactcagccttcgccgctttggcccgaaaagctgtggctcgctcgcacatcggcctccaggagccaggccgcacacaggcctcatgtccgctctgtcctttccaggtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtaagtatcaggagtaaggagggtggggtgcacctgcggacggtcctcggctgcaaggcaggctcagttcaggctcccgcaggagctgcctttggtagtacaagttgacatggaaagagaacaatgttctcactgacataggggattaaaccccaactcctggctcttaacgtaagttttttcttccttttgacttgtgctcctctctctttccccctccaggtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaccaagtgggattctggctgtacttttgatcttttcctgttcaattcaaccctgctgtctcctctgaagttaccttctcacttttcctcgtctccacctgtagtcttcgtacctcagagttcaagcccacatctccttggtacggacagaccatcagcactgccaggtgcaggccgtgagcacttggctgggctaggctggggcgtgagaacatgagcacctctctcgctggctcttccctcacattctgctgtaactttgctcttcagggatgtgttgggcatctctcatgggtgcctgcggaacttgctgccccttgccccttggacagagtttctttcctgcactctgggtggaaacacttcagataacccta

SEQ ID NO: 8200 - DNA, 1106 bp, Homo sapiens
ctcgtggttggactcagaggaatttgggagggtaatgatgaggcctgatgttttttcagttcttgcattttgtgagaaagatacaggctagaacaggcagctgaagggtgaaatcccttcaccaggggtgatgcctccccattcagccctcccctacctaccctgtcctcaggaacacatgacagctggaggcaattgccagaccttctcatcttccactgtcatctcctactccaatacgggtgatggtgcccccaaggtctaccaagagacatcagagatgcgctcggcaccaggcggggtgagttggggagccctcctgtcccagagaaggtaggattgagcggcaccgccagaaaccctggctgcttttttccggattgggttgtgtgtggtgtgtttatcctgagatggtataggcagggctttggaaggggcggctgagtgtgccacgttctgcctcatcccagatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgagccttccctcccgcttcctggctggcagcccctaacccggttcccgtggacatccctaacacatagacacttctggggcaaagctctgggtcagccccatattcctttttttttttttttgagatggagtctcgctcttgttgcccaggtgcccaggctggagtgcagtggcgcgatctcagctcactgcaacctccgcctcccgggtttaagcaattctcctgcctcagcctcccgtgtagctggaactacaggcatgtgccaccacgcccagctaatttctgtatttttagtagagacagggtttcaccatgttgggcaggccgttctcgaactcctgaccttgtgatccacccaccgaccgttggcctcccaaagtgccgggattacaggcatgagccactgcacccaactgtcagtcccatattcttaccgcacttggagcctcctccgctcgggcggagtcaggtgc

SEQ ID NO: 8201 - DNA, 1186 bp, Homo sapiens
gggaagggactgactcagaggaaggtcggggagagtgctggagacaaagccctgcggtcaggagggagaggaacagaggtggaccaggaaccgtagagacagacaggaacccaggaacagtgactagatggggtggtggggtgagccctgtgggatttccagccaagagtgctcagagaccatgtggcagcccgagggaaggagggaatggagagtggagcccagcggctggatgagaggtctgcggctgaaccgtggagctgcaggatggatgacggagctggaggacaggtcgtggaactgaaggacggtgatggagctgaggagtgggaactgaagcagatgctggagctggggtaaacagggtagtgggaactaaaagacagatgatcaagatgggggccacaaatggagtgggggatggacagaggagaggaagatggatgatggaactggaggagagatgacggagctgctgtatggctgatgaagttggaggtcaggtgatgatgctggggcctggatattggggagaacaggtggggaggaccccgatctcaccaagatgggcacccctgtgagtgagtcatagagaaagacgatggcgctgaccaagttggtgacctgcagggatgtcttggcagactccgagccatccagcgaggaccgccgcttccctcgggcatcctccaccacaatggctggtacctcaaaagctggccgggtacccaaggcccctggcccacccgctttggtccccccaccaccccccactctccgggcctgccgagccctccggggccgggcccacagtgtctggtagaaggtgatggccacacagaccagacccatgacaattcccccaagtagcaagaggctgaagcaaacgccaaagccgaggccgatcttggagactatgaactggcagccgcgggcatagtagcgctcgccgttgttgtgccagccaatggagggcagtgtggagaggatgaagctgaccatccagatgcccatgacggcatgcagtgcctgcttcttggcgttgctgaggcggtagttgacgggccagcgcaccatccacatgcgatggtaggagagggaggcgaccgtgaagcaggtggccagcgccagggtgtagtaggtggacacgaagaccttgcagatactctcgttccagtcatagtcg

SEQ ID NO: 8202 - DNA, 1526 bp, Homo sapiens
cccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggtacagaatctaaggcaagatgcagggaagataaactaggataatgttttgggataaggtccatgggtgagtgtgggaggaataaactgtaagtcctagttttgggtccttgctttaacgccttacccaccccaggttctatgcgcaatagatggaaaccaaacagcagcaaggtactagggagatcccccctcaccatcctgcaggatgacaactcccctggcaccctgacactacgacaggtaaaggaagagaaagtgcaagctgttactaggatatccaacgtagagggtgggagacccttttacccagatcttccctcttctgaacagcaactccccccaactcatacactgccgttttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaatttatgatcttcccccaaaagctattcctcattccctcttccctatccttgtgaatgacagcattatctacccagccaccaaacccaaaccttggccattatctcgaatccttccctcccaatgtcctatatcctagcatttggtcactaaatcctggtgattccacattttgtttgtttgcttgttttttagaggcagggtcttgctcttgtcacccaggctggagtgcagtggcacgatcacagctcactgcagcctcaacttcctgagctcaagcgattctcctgtctcagcctctccagtagctgggattataggcatgagccaccacgcctggctaatt

SEQ ID NO: 8203 - DNA, 1331 bp, Homo sapiens
taatagggtccgtgacccttgtgaggttgtgaagctcccttaaggcacatggtggctgggctgtggatttggggtatgggcagagagtgtggagagcacttccaggggccatgtctgagagactacatgatgccactttgaatgcccagtttgttcatccttttctgttttccccacttccccagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaattgtgtcctgtttgataccttgggggagaggcttaccttcctggggttagcaggagggcgcttaagaaaactcctaactctggccgcctccctgccaaagtcaagtctccacttttcactggttctagagctctaggaaaattggggttgggtggggaggtggagtagagtgactaaatgccgacacaaagccaaggaaagatggagtgaagaacccttccctctctttattcacacaggagtggaggatttcccaaatgtccctaactggctagctggcttcaggctgggactcagtccctgcagttcctgccaggccttgccagccggggcgagggttgggatgatcctggcggcctatgcctgtgtgggctgcccctcccgctgtgaaccctgcatttgtcccgcaagttttcactcaggtagactccctgggtacaagggtgcctgctcagcagtcgggcatgagctgctccgatgggcgaaggaggttgtct

SEQ ID NO: 8204 - DNA, 1175 bp, Homo sapiens
ggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttactatttttacttgaaaaaatgttttgcgtagcagactgtcatagccttgaacgccggctccctttcttcctccctccaagtggctctggggctgttgatttccgcagagcttgggttggggtaggggctcagcctcaccagctttcagcagctggtctaggc

SEQ ID NO: 8205 - DNA, 1197 bp, Homo sapiens
ggagatgagaaatagcagtggccatgagaacatgcctcctcctttcatgagcctgagattcctggctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaagtcaaggcttcacgtgttcatgaactgggtaactggcagcaagcatgcgcacgttcacatgtgcgctcctgggtctgtctttgtgtgtgccagcagggggcgcaaaagaatctggctggggcggctaaggggaagcaaggcctgggctccgaaacaggacccaagctgggaaggctggccctgagttctcgaggcccagctgtgctcttcacacaccctccatttctcccacatcacccatttttttaaggctggacagccatggctttgctgagccagattaaaaatctgatgaccccaacaggagctgcttccttggcagcagggttccttgtggctgtggggagcctgcctgtgcctgttgaggcacttctgtgcccagaagcccagtggatcgcgtggcctgctgtaggccccccagactccatttctcagtc

SEQ ID NO: 8206 - DNA, 1360 bp, Homo sapiens
gccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggctgaggcaggagaatcacttgaacccaggaggcggaagttgcagtgagctgagatcatgccactgcactccagcctgagcaacagagcaagactccgtctcaaaaataaataaataaaaaattggcttctccgatactcctcctgtcaagaatgattcctctgggttccctgaccttttgttctaatcatagct

SEQ ID NO: 8207 - DNA, 1360 bp, Homo sapiens; identical to SEQ ID NO: 8206

SEQ ID NO: 8208 - DNA, 1234 bp, Homo sapiens
cagggcaaggggtttgggggagggactggaagcgtccggcgagcaggcggaggttgctcaccggtgaacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtagtttattgtggtgctggaaggggccagtctggagacagtcaaggtagtttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttttttttttttgagacggagtctcgctctgtcgcccaggctggagtgcagttgcgcgacctcggctcactgcaacttctgcctcccgccttcaaacagttctcctgactcagcctctggagtagctgggactacaggcaggtgccaccacgcccggctaatttttttgtatttttagttcagatggggtttcaccatgttggccacgctggtctcgaactcctgacctcaagtgatccgcccgcctcggcctcccaaagtgttgggattagaggcgtgagccactgtgcccggccggtagtactcatttt

SEQ ID NO: 8209 - DNA, 1189 bp, Homo sapiens
atgtgaagtcacaggttgtgcccttcctcctgtttccctctcagaccattcactggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcac

SEQ ID NO: 8210 - DNA, 1220 bp, Homo sapiens
ggcagggaagggggtacacaggggttaaggggaccgagggaagtgtggtccctgaaagagaggctgggatgtgtgcaggccattgatcccttctcctctctgttcctgccctccagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaagctctgtgaggcgcctcctgactgcctggtcctgtgtgggtgtggtggaggctctggggcctcaggggctgtttgggtctctgcacagagctgaagtga

SEQ ID NO: 8211 - DNA, 1626 bp, Homo sapiens
tgacctgcttccttccattgttgttcagcttaacagctctcattcctcttcttccttacagggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatgagttctgctggtcatgaagctgggatggcagaaggtgagttggcgtttggaggactgggattcaacagtttctgcctttcaaattctcactggtatattggtta

SEQ ID NO: 8212 - DNA, 1221 bp, Homo sapiens
accatgcccggctaatttttttgtatttttagtagagacggggtttcaccatgttagctaggaaggtttgagtatatatagagtaacaggattgctgagtcaaatggtagctctgttttaagttttttgagaaatctccagactggctagatgaatttacattcccaccagcagtgcataagcattacctttctccacaatgccaccagcatctgttggttattgaccttttaataatgaccattctgactcatgttatagtatcccattgtggttttgctttgcatttatctgataattaataatgctgagtatttttaataggtttgttggccacttgtatgacttcttttgggaagtatcatatcctttgcctgttttgttttgtttttaatagtttgaaacagaaatttattctcagaataatgcacaaaagcataggtcgaggctactgttgggaggcttctctctcttcctcttcctactccccctactctctgaatgccaggtagaacacagttgaaggaaacatgcaatcacaaacaatgatcaactctaaagacaaaaaggtttggtccaaaataactcaacataattaatccaataactgtgaagaactttgctgagtaggattaagatattgcagatgtttcctgcacatgtttccacagggtggctcttcagtgcaccagcggggcctgcttgagggagatgaggactgagcacctctgggagatgtctttagcctgccttctggacttggggttaaagttacacagccaggccacactttcccactcagtgcctgggaagaactggtcaatgtcatttacaaaggcttcttctgctgccctgtttgcttttgttttctgtagttgctcatcctatctcacatatcacacctctagctcctttattgccttttctttccactctgcttcttgcttctgagaattggcatcaagggcttccaagcgttctgtttgctcttctctccatttacggatactttcaggctctgactgcaatctatccacttgtgaaatgctgcacaactgtctgttggactattactttcctggtagtatttaccattcattactccatcaacagcatccagcttgccatgtgcctggggcctgggggcaccaccttccaggatggtgaaggcctcgtcattctttttttttttttttgagacacagttttgctcttgtcacc

SEQ ID NO: 8213 - DNA, 1709 bp, Homo sapiens
accatgcgtggctaatttttgtatttttagtagagagggggtttcgccatgttggccaggctggtttcaaactcctgacttcaggtgatccgcctgccacggcctcccaatttactgggattacaggggtgggccaccgcgcccggcctttttcttaatttttaaaaatattaaagttttatcccattcctgttgaaccatattcctgatttaaaagttggaaacgtggtgaacctagaagtatttgttgctgggtttgtcttcaggttctgttgctcggttttctagttccccacctagtctgggttactctgcagctacttttgcattacaatggccttggtgagactggtagacgggattaactgagaattcacaagggtgggtcagtagggggtgtgcccgccaggaggggtgggtctaaggtgatagagccttcattataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactggtaagaaagaaatttatccttgaaaggccaagttccttaagggaaaagagagaaggagagagggttaagggatcatttccctcttgagcaatgatggaccattactataaagaagtgttattatcaactaatcctctggaaacccctttttccattataacttggtggcacctgccctttgaactatgtcccaggtctcaggagtgtgcattgagttgaaggacacagaattcggcagttgaacagtgtgcagtaagtttgagaacctatgggcttaggcatggtggaaacaaaaatgtatcgttatagttaaatgaaggtgatgtgtacatcttcacatagtgctggacacatgtgaataaatagcagatttattgctaattagccagaagacctaacgtcatagctcagggatgagcatgattttgttttgccaaaaatggcatggcaaatcacgatgagatttctgtaatacataatttgggtaattctttctatgtcagtaacggctgtctcttctccattctctgggtttgtggatgttactgggcagctctgagtttgggagcacctcccatgtctaattctcctaagtcctgggaagcgttgacccaactttatggtaaagataattccagaaagtttaatctactgacagtcaaacagaatgtagctagaagtccagtttggcttcaaaacctgtgctagtactcatgcttctgactggtagctgcaaggggtgggggatactcgggatactcataaagccgctaccacttttttgaaaatcaatttttcagtagttttcaaaaacttgagaatgaaccaactttaccaagaatgccattggtaacactgaacgctgtaaaatagcttaaaaagcgcatttacattatgactaca

SEQ ID NO: 8214 - DNA, 1184 bp, Homo sapiens
gcctcagcctcccaggtagctgggattataggcacgtgccaccacgctcagctaatttttgtacttcttagtagagactgtgtttcaccatgttagccaggctggtctccaactcttgacctcagataatccacctgccttggcgtgagccacagctcctggccaaaaaaaaaatttttttttaattaggcaggtgtggtggcacatgcttcaagtccaagcgatttgagaggctgaggtgggaggattgcttatgcccaggagatcgatgatgcagtgagctattgtagtgccactgccctccagcatgggcaacagagtaagaccctgtctcaaaaaataaaaataaaaataaatccaagccttttgactccacagccactctttgtattgtacgtcagggacaggaggagcttgccgttaattgcttctgggaacctagatactaggttacactgtctttaaatttaattttctctgttccttgctcttacaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctgtaagtaaactcaccttatcttaaaaccagcctatgtaagctgacatgaagatactccttaataatacagtagtctgggcctggcatggtggctcatgcctgtaatcctagcactgtgggaggctgaggcgggtggatcacctgaggtcaggagttcaagaccagcctggccaacatggtgaaattcaaaaattagctgggcatggtggtgcatgcctgtaattccagctacttgggagatcgaggaaggagaatcgcttaaacctgggaggtggaggttgcagcgagctgagatcgcgttactgcactctagcctgctcgatggaagcaagactccatccctaaataaataaaaaaatacagcagtccctcctcttcttcagtttcagttacctgtagtctaaaaatattaaatggaaaattgcagaaataaataattcataaagtttaatttgcggccagacacagtggctcaagcctgtaa

SEQ ID NO: 8215 - DNA, 1041 bp, Homo sapiens
actttgggaggccaaggcgagcaggtcacttgaggtcaggagtacgagaccagcctggccaacaaggtgaaaacccatctctacttaaactacaaaaattagctgcgtgtggttgcaggcacctgtagtccagctactcaggaggctgaggcaggagaatcgcttgaatctgggaggtggaggtagcagtgagctgagattgtgccactgcactcctgcctgggtgacagatccagactaggagataagatacagaagataattcatttgcagaagggatattagtattgaacgaaaacctagaaaaaggacttcttacccactgggacttttaagtttatttttgagggttctgtgtaactggtgtgcagaattgcatcaaagctgcatgttttcttttctcctaggtgttctattactcaacaggaatcttcaaggatgcaggtgttcaagagcccatctatgccaccatcggcgcgggtgtggttaatactatcttcactgtagtttctgtaagttggatggtttggtaattttgaggggagaaaagaatccttgctacagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattggaggaaaggtgcttggaaaaactctcaagctctgttactccactgtttttacactaaaacaacaataatcaacagaagttatctgtgatccccagaatatgtgagaatttttccccgtgaggtgtgcaatcagttccgtagtggacaccatctaggtgtcctgcgattttttaattatgacactgtctacctggagatagcatcagatctcacaggttggtggcccagttcccaagactgccccccactcctgatgccagtcacaagctccaggttgttttacctgtgcttc

SEQ ID NO: 8216 - DNA, 1879 bp, Homo sapiens
tccagtaggttacatggtcctgagagataagagactcaaagagccacccagcagtgaagacacaaactaccaccccctccaccaccaccagtgggcttccgtggagtctggggtacagatcagactgcactgtatttgtttccagaatggtcaattcttagtaatcctacccgagactgtctttttctctgccctcccagttcgtgagtggaattctatgcctacatttgcctgatgcaagtttttaaatatttccaaactgaccaacccagtttctcttaacttcttccttccccaattttctttcatttttaccaagttaacttcacattcttatctccagataagttctttagtataatctattcctttgtcttccccattaattacctaaatctcattggatgttcttttcataccactcataactcaaattctcctaatacagctccataattaataagaaacagtcatcaatcacaagttttaaggactattctctcctctgtcttccctccctccaggtcaccccagctctgatatttgccatcacagttgctacaatcggctctttccaatttggctacaacactggggtcatcaatgctcctgagaaggtgagtgccaggccacaataattagaatttagaatagggaagttattcctttaagtagggtttcaggaattcagaatttaaggccaggcatggtggcatctgcctggagtcccagctactcctgaggctgaggcttaaagatcacttgagtccaggagttaaacaccatcctgagcaacacagttagtgagggtccctccccaaactaggggattttaagacaaactttgtatctatcctgtccaagactgaagatggagacaatattggtggggaaaattagtggggtcatctaatcgaagcacaaagctcacttactcccggaacgctgggcggtgctgttcttcctcccactctttcacctcatagtgatgcacatcctgtattatcccttaggggttagttacaaagaagctgggttcccttagcagagggctggggtagactgtgaacatcggtgctgccacctactgggattttcaggacaaatagaattactattccagcgagagttaacataaattccaatacgttatctgccccttccattcctgtctatttattcccttgattctctaggaaggaaatgatccctaatgtttgtcttttgttctcatccaactgtaacagtctgttcttccaccaacccttttattttgcagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggtattgactagaaactgggcaaggaagtgggctctaccagccacattgaggacaagtgtggagagttagggcagggaggtgatgatgcctttgaataagaacaccttgaattctaatcaagggaaacctagtccaactggccccgaatatgactgcccttgcttggagctctactaccctggagagctcccacccagctgtgcaagagatgaactgtgagtgattggcctttgcagtccagctagggatagttcagaattattccctagtaaactcaactatggggtttctagaaacatacttaatttacaaggtccgaagttgtttacttgtattataaatgtttttattattttacccaggattggtaggaattatttttgtctatggcaaatgtggataatgacaaaaaaaaagtcttattctatagaagcttaac

SEQ ID NO: 8217 - DNA, 1267 bp, Homo sapiens
ctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaat

SEQ ID NO: 8218 - DNA, 1637 bp, Homo sapiens
ggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtgtctcttttatcttttaatttgcttatttgattaccttttaaatttaattgaccaaatataagtggaccagtagttaataaaggatatttatatcactctttatta

SEQ ID NO: 8219 - DNA, 1167 bp, Homo sapiens
agggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccattttttatatttaatcttgtagtcataatgttgatcacaaatgaatacatttatgtgcccgggatccaggaatcctggttttggtggcagtttcccttgattttattgagacttttaagttggtccctttacatttttatttctagttcacaatccaaaaaaaattattaatcagaattcaggtttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtaatatacatgtttgcagtgacatttgctagtcctaaatgaaactaaagactggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcagtgttttcatatgtg

SEQ ID NO: 8220 - DNA, 2272 bp, Homo sapiens
tttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggaggtgagtaactgacttctaatgctgttggagagcacacagagtagaggaatgttctgagtgagctaaaagataaaactggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgagggcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagacataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaataaaatgaagtctgtctacatatagaaaccatattatatatcagagtatgtagaatcacggaaaaggaattacataaggtgaggggaatttatccagctaaagtaatcttttgaattattattattatttttttttgagacggagtttcgctcttgttgcc

SEQ ID NO: 8221 - DNA, 1970 bp, Homo sapiens
gaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccaca

SEQ ID NO: 8222 - DNA, 1465 bp, Homo sapiens
ggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaa

SEQ ID NO: 8223 - DNA, 1099 bp, Homo sapiens
agccacaaaaaaagggctcttcgaaaagattaagtgcatgactcttagatacccttacccatcacaacaaaagccaaaattggagatagaattatccatcaaatgtcaatgaaaaggctttttgtttaacggaatgaatctctgtgacacacaggagacctacatggttcttgaaaagtttatactaatagaaacattgtcagcttcaactaaaagggacagagagagtatagaataaaagaagaatatcagacctctcaaatcatgcaagcaggaaacgagatctgataaaacaattcagctgcaaacacatccttcatgaaaaagggcaaatgatttcatgagtggatccttgagcccagacaatagagaaatgaattaaagaggattattcccaggtgttaaaactatgctgttttcctagccagatatcagcacttcttgggactaaagactctttttgccctaggatggattatgtccaggacctcaataacacctaatttagatgactgagatgatgagatttggaacttttgagctaatgagactgtgagcttttaatcttatgttaatgttatgatggatagagtgaatgcactttgcatgagggatgaatatgaatctctggggccaatgggaagattgtggtaaatagaataatggcccctgaagatactcaatttccaaaacttctgcatatgttactttatatggcaaaagggcctttgcagaaatgattaaattaaggatcttgaggtgtgaagtttattctggattatccaagtgggcccaatgtaatcacaagggtctttctaggaggaagacaggaagatgagagagatttgaagatggtatgtggctgaatttgaagatagagaaaggaaccgcaagcaaagaatgcaagaggtctctagaagctggaaaaggcaaggaaagagtctcccctcaagctccagcaggaatgcagtcctgacaccttgagtttagcctagtgagacttctgacctccagaactagaagatacaagtggtgttttaaggcactaaaacgaagaactagaagtattgttttaagcccataaatttgtgataatctg

SEQ ID NO: 8224 - DNA, 1108 bp, Homo sapiens
agggatcaacttctctgacaacctaggccggtaagtagtggttctgctcatctcctgggtcgtgatacatggccggccctcactcccagcagctgggcccctgcctgctgtctgctgccattagagcccacagctgggctgcgactgctcagaccagccagctggagggaggggctcagcagctctgggtttggccctgagagagtagttggattttaggctggccattgctgtatcaggacccaatcaattggcctagacgggatctctcagccttacaagccctctccaggtggtaggtacagagtggagagaggctgagttttgatcacagtcggagagggctgacggaaggggtagaacggagcagctggtgacatgggtgatgacccgggagttcctgacgtccacccactgggctcttgtctcccccccacgtgtgtggtgatggtgggcatgcccttccccaacatcaggtctgcagagctgcaggagaagatggcctacttggatcaaaccctcgtgagtgaccccagtgtcacagagggtgacagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacaaagcctcctggtctggctccaaagcctggcagggtcttttccccgggggagctgcaggcagggaacagtcctgatgggtcatccccttcactcccagcccagagcccccggccaggcacccccagggaaggctctggtggagaacctgtgcatgaaggccgtcaaccagtccataggtgagcctggctgcctccagctgggtggacagatgggggctggagaaggggagaacaggaaagaggggttgcctgccctgtttcctatataagtctgaggaaggggagggggtcgccatgggaatgtgctgtaggggaggcaggtgttgctcggagccccagcctctgttcctatgcaggcagggccatcaggcaccagaaggattttgccagc

SEQ ID NO: 8225 - DNA, 1227 bp, Homo sapiens
ctgtagtatgcaaagatgcgatgaaaccaaaagggtagagtcacagttgaagatcttgatccattccacgtatgccaaccgtccccacaatggggcccagattgcttctaccattctgaacaccccagattcatgaaaacaatggttgcaagaagtgaaaggcatggccgaccacatcattagcatgcggactcagcttgtctccaacctcaagaagaagggttccacccacaactggccacatagcactgcccaaactggcatgttttgtttcacagggctaaagcctgaacaggtggagtggctaaccaaggagttctccatctatatgacaaaggacggccgcatttctgtggcaggggtcacctccggcaacgtgggctaccttgcccatgccattcaccaggtcaccaagtaatgtacctggtgcaaggaaacagagacgacctttctgtcttcagcctctgctattgggagcttcacacagaggatgagagagagcggatggtggtgagtggatcattttcttcaaccacggtgtgtaacactcagcaattgaatgtttctcagaaaagaacgtgtagtgacacagggcagagggatccgtggctggcgtctggaacattgtggctctaaaccaaatgctcccctgtccttttatccccaacttttctcaaagagtttacatgtacaagaaagtcaccacaccaaaaaacctgtcaattatgccattgcaatatttcagaagctttaactgaagtgtcatatagtgtcaggttcctcatgagaaatagcacacattagaggctttgagagaagacctagttctgtcatgaacacttggcctcatgtctgtcctcccatcatggagcagccttatcaacagaccacattgcagaaattatgttttatgaaaaccagtaagtctgctgccactacagcaaggaaaggaatgcagtttcctgtcttatttaagaaaaagagaaggctctcttttctcctttgccattgctgttcttttccttatgcacaaagatttttaatgaatgcagatttttatctcattctactgcctgactatcaaccccatcctattgggatttatttaagaataaacataattttctgctgatgccataccctcacttttctcagcaaagaataatggagagtaggtaactgtactttatctcagcatcctcttgaatgattttgtaatcttctcta

SEQ ID NO: 8226 - DNA, 1286 bp, Homo sapiens
atgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaatcaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttgcaatttctctttaacaaccaaggggtttattttcaaagcgatattggggaattgatttcacagtttgttaccttagtaggtaacggtaaggttattctctctttttttttttggttatgaaaacttagggactacaattagtataaaa

SEQ ID NO: 8227 - DNA, 1412 bp, Homo sapiens
taaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaggacagaatgtttaatgggagtgtatttttgccgaccttagcgtgtgtttgtcttctccaccacttgatttacttgacttgattaatagtaaattcaaagccaaatgtaaagttaagttaatgctgtttcacaaatttaggcatataagcttgagatgataaaaaattggattcctgttgaaatgtacagctggaaattgacaagttcatgtctgagttcagtagtaggcatgaattatttggtactgtctctttttgagtaatcttcattcagtgaggtgacgtgatgacctttagattaacgaaggagttaatagttctaacatccttcaacttccagcctgaggtttttaccagtaactgctgtgttgtaggtatacaagggagctctttacaactacatttctccccctcccagccatggtgcccctaagttgagaaaaactatcgcagct

SEQ ID NO: 8228 - DNA, 1041 bp, Homo sapiens
ttgctcaagatccatatatatagggtatgccttgtacataacacagaccacatatttgaatccagttaacattctctgaaagaatgacccatattaatggggattcagagctaaaacatttggggttcttcaaagaagagaggcatttatcaagaggaagctgcctctaagcatgagttgaaagcagttgtatatcagactttatggagagtagtggtatttagttgccgttttgtaagctgttcttatatggtactaattttgttttgttttgttttttgtttttgtgaggttttggtttcgttttgttttggtagagatgccagggactgaatatggtactaatttgtgactcatacttaagagtagttaaatttttgcatgctaattttccttcacaggaaaattcaaacttttaagaactttcagtcttgaactttccactgtcatctgactttatctgatttatggctttgttttgcattttaggccaaggcaggtgaagcaccaactgagaaccctgctccacccacccagcagagcagtgctgagtaacaccaggctcctcaggcaccttcaccatcggcaggtaagagctggggcagcccagtcttgagttggtattttctttttagtatcactggtttctcaacaagagtacaaattagtctaaactagttctgcagttcatctgtgccaaccccttgtctctattgggactctgtggaaaaagtgatttggtggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgaggcggtgcagcatagtgtat

SEQ ID NO: 8229 - DNA, 1176 bp, Homo sapiens
ctgttggtttcagatatgaacttggaccacttacccagggtaatgggagagaagaaaattctaatgtaaatacagggagctgggtagatttgctaatgagaacgtggaaattgtcttctgactgtttctctttcttgatgaaataatgaaggacagtatttggctcttagggggaggaagggatgttttgagaaaagaaaagaaagttgagttatggctgtatggtcaagaattgcagacattgttggtgggtttttttgtttttttaagttgttctttctttcccctggaagttgtacaataagttaattttattccactggcttaaagtaagtttgttgtaaagaaaaataaaagagtattttatttaaagagatgaatgaaatgtatccgatttcaaaatgttaaattgataggcgaaaataaagttaggtgctctgggactaagcaaatgagtattctagtcagactaggtttgtcttccttttcagtcgttcacgaagatttactcataaatagtttgtgttgcaactgagagtgcctaattttgtaatgaagcattttgttttttacttctaaaaaaaattctgaacatagctgtatgcactgtatcttatcccctgtgctgtgacactcactgtcagctctcattgcctctccaggctggtgagattggagagatgaaggatggagtcccagagggagcacaacttcagggaccggttcatcgaaatccaacttaccgcccaaggtaccgtaggtatgtcgcattttccactaatggccagttaaaggacttgtgtgcacaatggtagaatgaggactgtgtggttccgttttgtggatttattatatatctagaagatgtgaatgctttgactacatgccagagttttcaggtggtggtgtgacatttcccacctacttaatactagaatttttagttatctctgcgccaaagcgtcattttgtattctggaattataataagatgtaaattaatacttaatttttatcaaaataaatcagataaattattggtgggcaattctgtggtaatgctgcagatggaggaagaattgagtgtcagaggatatttgggatagtgactgttaatcactgaggcagtccagtagaggggttaaatcagggtatgatcaaatcgcctgaatttat

SEQ ID NO: 8230 - DNA, 1287 bp, Homo sapiens
attttccatttgtccatatgagaataagaattctaaatctgtttcaaggataataggaaaggctaaagaaggactacatgtgtggagaatattattcatcaaagaccctttcttcttgttgctgccaaaataggagaagtttcactcagtacctttgtgctggacagagaatcatatgagcccatgaatagggattgtcctcttggtacctcctagactaacataggtttcaacacattctaggaaaataacagtatctcaagtctttcccattgaggaatattcttcctggtctagcattgcttctactttgacagttgtatatttgctaatttatgttctttaaagaggttacacattgcttttgcgattgacattactagacaagaaagcaaaactcaggttgtatgagcaaacaagccatatatgtttaaatcaggatgtgaagtaccttgctcactttgtttaaaacctagatctgtttttaaaatcacagtgggaattcttagtatgttctgccagtcttatactctagcagtccaaggctgttttttgagttagtgtatattctttttaattttgaggccatctttttattttcttctcagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagttctttagtggtgatttctgagattttggtgcacccatcactggagcagtatacacggtactcttaaggggaaattttagcgctcagaacttttccagagccgctggtctcattagacacttgccattcagaagttgtatcagttaggatatatttggctacaagtaatagacatttaattatcttttaacaggaagacttaagggagacagtgctgaggttttttttaacaaggtttctcttcatttggctcttttttctggccagaacctagtcacagacattcactggcaaaggggaatggatttccatcattgacttaaccttgttgt

SEQ ID NO: 8231 - DNA, 1221 bp, Homo sapiens
gctgttacggttgtgacttcagataaatcactttaactgttagcctcgtgttaactcatctgcaaaatgggaggagaggggggaggccagattattactaatacgttctgattcttgagataattttgtttactcgtcagaaatatttatccccttggcattttaatttgtttttctttatcactgcctcctttcctcctccggagattcagagaatctctgaagcttaatggtttgaggtaattaatacatctgatatgatcaggtgatcagcctgtaacagtagtgtgtagtcactgcacacactgcagttatagaaaaaacatgttctgtttaatccacctgtcaagatgaatagcacaaatcaaggaagtaatgtggaatatagttttatagtgctttcttgttgttgtgttggagatccaacttagtgggagaatggtggaaaaataagaatcggtcaacagtttcttcaagttcactctggtgtacttgaaagcagtgaaatctgtggccaatattgaaatatacatcgaataaaattttctgttctctttccagactgccatcaagaagaataacccacggaaatatctgcgcagtgtaggagatggagaaactgtagagtttgatgtggttgaaggagagaaggtgagaggaaattgtggttgggtatcaaagtgctggcacatagtactgttgcacaataaattatctatcagccccttatgaattgacatgactttggaatttttgtacaatagcaggaagtgacttttaaacagaattttttttttttttaagatggggtctccctcttgcccaggctggagtgcagtggcgcgatcttggttcactgcaacttccaccatccaggttcaagtgattcctctgcctcagtctccctaatagctgggattacaggcatccaccaccacgcccggctaatttttgtatttttagtagagacggggtttcaccatgttggccaggctggtcttgaaactcctgaccttaggtgatccacctgtgtcagcctcccaaagtactgggattacaggtgtgagccaccacacccagctagcagaaatatttttgacattgtcattataaacattctgcaataaagatactttaatttcttatttaataaatgatcaactctgattatggaaagaaaagctgatttctcaatttaaaaataatttatatttttatacc

SEQ ID NO: 8232 - DNA, 1159 bp, Homo sapiens
aaatcaaaagggtaagattcctaacatcccacataacacagcagacaaactaaagttttaatctagctttggcccttacaaattttgtgccctacggcaagttacatctcgcttagattttttcattttaaagtggaactatctgcatggatgttcgtacatgctatataacacatcctattccagagccacctaccatcagttgagctctaaatggtaaatgccacagtgagaagcagacaggaaggggcggagcgccagcggcgcccggggctacgcgccgcactgcaccgagcggcggcagcggcaagcttgggtgtgagcccgggagccgctttgcttaccgtcctgccggtcccagccgtcgctaggaggtccgcgggccctgcggcaaccctcgctacagacgctgggcgggcggcgacacctggctcatggcccccgcggcggctccgtcctccttggccgtcagggcctcaagccccgccgcgacacccacctcgtacggcgtcttctgcaaggggctctcccgcaccctgctcgccttcttcgagctggcctggcagctgcgcatgaacttcccgtacttctacgtcgcgggctcggtgatcctcaacatccgattgcaggtacatatttagagccatgactaagctaacggcctccggggccagcatgatggccgactcccagggtccgttgcggcgcggcggagcagccaatggcgagccccacagtctcgcgagagtgctcaggcgctcttcgtggctgccctcttagctgctagcggagctcctcagggggcggccgggagcctacaatccctagaaagagaatacgctgttccggaaacagaactgcagttaagaccctcgaaaacatctaagaaagtgtgcatcctaaaacacctgacgaatttcagaatgtgacaaagcgcagaggatgcattatttcaaaacaaaacagaaggctaaaatttgcaggaaaaagaaaatcagtaaaccgggaatcctcggactggattgtaagcaagatttcaatgaataagaagctgaaggtattaaggctgtgatatagaaggtacatatttcatcccacaagagaaaacaataataatcagaaattttcggtgaaaaaaacgcaaaactgtacaggaaaa

SEQ ID NO: 8233 - DNA, 2113 bp, Homo sapiens
atttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagc

SEQ ID NO: 8234 - DNA, 1258 bp, Homo sapiens
ttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaagtgtctgtcctttcttttcagcaagaaattaagacagtagctggttgtccttcgctgtttcagacacaaaacccagctttattgtttgcattttaaataatactctgccagtacacctatagtcccagctacttggaagactgaagtgggaggatcacttaagctggggaggttgaggctgcaataagactcgtgattgcgccacttgcacggcagccttgggctacagagtgaaaccctgtctct

SEQ ID NO: 8235 - DNA, 3523 bp, Homo sapiens
ctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaaagaggaagaagaaaaattaagtccatctcagagcagcaaaccatagatacatggatgtagccagatagccttcagttaactaacatttgagggccaacaagtaagaaatgatgaaaggaaaaaaatgcaattaatactaaccttggacgaagggctttgttttctctaggaatccaacagtgctagtgaggaaagtagatatttctaaaaacccattctgggtgttgctgttgtaggagagatcagccctctggtaagatgccatgaagctgtgtgtgtgtgcaagtctctgtccctacctttagaatccatacctctgtcaaaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccattatgtttttgttgtaaatctcatatccttgcactactttcagcatatatcacagtacgaaatcatttatatatatatatatatatatatatatatatatatatatatatatatatatattttgtttgtttgtttgttttctgagtaaaacatttaaatatgttctggttagagacaatctatttaaaaagatttttttcttattaggattttccctatattaacagtttgtgatgttttcatgttctttagaccggtttttctcagaataatgtctacatacatacctcttctaatgtgtgacatgaatttaatatctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattat

SEQ ID NO: 8236 - DNA, 1102 bp, Homo sapiens
gatgattagaaataattcttaccttggggtgagtcagtcattttttctaattgtgttctgagaagccaggtggggtgagagtgaagctgttcttcataaatgcctcaggtatactcagaactctgggtccaccaccactgctcctccagagaagtgccatttttatctgttgtatatataagttagggtttttcaaactactgttctaagttcttttctacatttctatgaactagaatatttactgcacattgggcacttacttgctcttgattgcatattaatatctagtttattggctgttttctagtgtatgtcttaccatgatttttaagttttgtggtagagatcttgttttttttttcttttctctacctgtagaatctaactggtagtcagtaaataattaccaaaagtataacttgacccacatgagtcatttctgttgaattttctccttttccaaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagtaagtgttaatgggataaagctaattggaggaatcatgtgttataataaattaatatgtacttttgtggatttttaaactctgtttccttgaagactttcatgcacttttagttttgccatttttttgaactctccatgcttttttttttttggagacggagtctcactctgtcgcccaggctggagtgcagtgtcacgatcttggctcactgcagcctctgcctcccgggttcaagtgattctcatgcctcagcctccagagtagctgggattacaggtgcatgccaccatgcctcgctaattttttttttttttaatttttagtagaagcagggtttcaccatgttgtccaggctgatctcgaacttctgacttgaagtgatctgcccaccttggcctcccaaagtgctgggattacaggtg

SEQ ID NO: 8237 - DNA, 1253 bp, Homo sapiens
atacacatttatttatataaaagaggatttatatatatatacacatatatatttatataaaagaggatatatatatatatatttggatacaaggtttggctcgatcacccaggctagagtgcagtgacacaatctcagctcactgcaacctctgcctcctgggctcaagtgatcctcccacctcagccttccaagtagctgggactacaggcacacgccaccatgcctggctaatttttggggtattttttgtagaaatggggttttgctgtgttgcccaagctggtctctcactcataagcttaagcaatacccccgcctcagtctcccaaagtgctgagattacaggcatgagccactgtgcctggtcaaaaaatacgtattttaaaacttttaaaaacaatacttaaaaatactctacctccatttgtcttaataagaatatcctcattttatgtggtttcttactccagtaacttatttttttcctcctttccctctaggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtacccaagaaatatgtttccttattttaatttgagtttttaagatgattcatctattgtgtttttcttgcatcgtattgtttttggcacatttcttggcagttttattcattaaatgtagtcagcatcaggttggttggtgaagagctttttcttcaactgtcaacatgattactcctctgttacttaactacctgccagttttcttgatcttggttctgtaaataatatatttctttttttttgagacggagtcttgctttatcgcccaggctggaatgcagttcccgggttcacgccattctcctgcctcagcctcctgagtatctgggactacaggcacctgccactgcgcccagctaattttttctatttttagtagagacagggtttcaccgtgttagccaggatggtctcgatctcctgaccttgtgatccacccgcctcggcctcccaaagtgctgggattacaggcgtaagccaccgcgcccggcgtaaataatacatttctaatgcatcctttcctaactcttctgctctagtttatgttcttgtcatc

SEQ ID NO: 8238 - DNA, 1180 bp, Homo sapiens
cttggaccatatgaccaaatacattttcaagctttgcttttgacttcagttaaaggcttagtatttataattacctttcatgtacttctgcaacttattttgaggaagagttgattacacaagtcaaaaagtaagttcagcatattaaaaactcaaattagttaatattcaaaagtatataaaaatattttactcagaagtgaaccagattctgagaccagagctttaaacctttgctgttttcttgaatgttaattttacaaatgccagtactgcaataaactgttggtttatttccaattcctaggtttggatggaacaaatgtattggaaagactaaggaaagctgactcacttcctttttgggatatggaaaaaaatatttagtttagggtgccaaaataattgaaagcattgtagccgtgattttgtttaacccatttccttgatttgctgtatgttttctttaaatttatttagttactttgcatgaatatgactctttcccccagataataaaaaattgaaatgttaaatatttattattttgaatttagatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttggtaagctttactactttttactcaaacagtatattctttccatgcaaatatcagtggctgctatttatcattggttagatacttttaatacaacttcatatgaatgtgtccattcttcttctgttctggaattgtatcctgtttgttattaatagtgatccaggtacttggattcatctttttattatgtgaaagtttcattattattggacttgtaatgaaatttataactccctagatactcctgaaatgacttttgtaccagtaaaatatatatatttccatcttttccttctatagttcaagaagaaaaagtgaactgtagacccttatatagagaaaataaaaccacatttaaagtagaccatttgcaagaattttaggaaactgagtgatttgtagcaggaatataagtttgaagcatggggtcagaagata

SEQ ID NO: 8239 - DNA, 1159 bp, Homo sapiens
actttgagatttattctgaggacaagcatagtgacaaattacacctcagtatataccaatgccttagagccatctaaacatccaggagccgtaagaatcacttagcactgcaggaagaaatagttattttgagaattcagtttgccatctgactaatactgctgggataagccttttgtgtcagagagatgacaagccatcaaggaaaagagagagaaagttcatggaaaagggcacacaaaatatttaaaaaaaaaaaaaaaaaaaagaagtaaaactgtaatctcattattgggaggcattttcaggattggctctagaacacactgatctgaaaatttcccacaatcttatatattgctgggataaatgtcttaaacacctcttcatatgtttttttttttttccccttccttggcattaactgatgataccagtgtaataggagggatggatctcacctttagaatatctgaaagttacattttattatctatttttagctcattttttgtatacttctctaggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggtttgttttttgctttttcattttcaagccacttttataatgggttttgagtcgacagtataatgatttgagtacagatattcttttttcttaacagttgtctggggtgccaaaggtaccttttacagaaattttactcaaccttcatgattctagggataatatattctcttccacataatcctaggatggagagatgtattggtatgagaaatggctgctgatcagtttctagtcttaaaagcttatgtaagtgattttcctcattttgggtaaagccactttctgaatttcctaggggcaatttctgcaaaccaaaattatgtaagatctatactggaagaactggctgtcctaagttaggaaaacaaagcccacatgtatgtgtatatctatatctatatctatatctatatctatatctatatctatatctatatctatatcttttattgctgtt

SEQ ID NO: 8240 - DNA, 1430 bp, Homo sapiens
acatagcatataaaatccatccattttttaaattgtacaattcggtgactttttagtaaatttacagagttacgcagttatcaccacaatccaattttagaacattcctatcaagcacaaagattcttgtcctaaatttctttatctttttttaaaaaatgcttcttgaacaaaggatctatatcctacatttccttctcctttaatactgagctacttagcttcttagtcattacatagtcattattcattgtacttttaaatagctggattaattccaatgaaaccatagaatgtatcacaacttaatttggagagttagccattaaacagcttgacctcagagtagactcttctatttcactgtattactttccatttccactctaaagagagtgcacatccttttgtgttaatttatgtatattttatatttatttttcagttcttgattctttatctagagcaggtaaattttacctctgggtttcaaagtattcttcatttcactttgttgttctaggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtaagaagctctactgatagtaaattctgtgtggtgtttctgtttttcacaggttcctgaaaacattgactaagataacatgacatatatattggtttccagtaaacagctctttaatggctgtctattttaggatatggtgattagaatacaatctcaagtttaaaaattgctagttttttgccttggatgtcttagatattttttctttctaaattaagtccatgtttgctgactttgggtgttgtctgcagattttgctcggattgcatcattaccatgaaaaatgtgggaagaaattgttttcagaactctttcccttcccctagaagctttaattccattttcagtactttatagtaagaatatagcttacttttttttccctaaatacatgaatgacttgatttccaaaactttgccagcccatgcagctttacttctagtttgttgttgttgtttgttttgttttgccatgccaccctgatcatagtccagggaagtacaact

SEQ ID NO: 8241 - DNA, 1170 bp, Homo sapiens
aggctcaggttctttgttcttccacatcaagaaggaaaaaacctattgctgatataaatctacttcagtgccaactgtaacccctgtgatttttctcattgcttacctttctctgtctgatgacatgaattgtgtgaaagggtggaagctgtgagtccagagatggtagttgaagagtaggatttgacagcagtgcaaacaatgaaaaagcagtgctctctctctgccgggtatcttgtactgaacttgaggctgctgccaagttagggactattcccaaatgcttgtttggggcttttggacaccttaaaaatatatatgaattcattatgtgaattattttttataggtgtatttgacctattggtatgtattactcaagatttgtatgtgttaatgtgaactaagatcattttaatgggagaggtgacgttatgatagaagaagaaaatttagaaataagtttaaatttttctctttatgttaataggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatggtaagtgatccttgatttttaaattgcaagttggaacagctttgtagcactctaatgtctggctttagtgaggatcaggaggagggagggcatatccaaagatagttggcgggaataaaaaagagttaaaatcctacttgggaggctgaggcaagagaatcacttgaactcgggaggccgaggttgcagtgagctgagattgcgccactgcactccagcctgggagacagagaaagactgtgtctcaaaaaaaaaaaaaaaaaagttaaaatcccagcactttgggagactgaagcaggcagatcatatgaggtcaggagtttgagaccagcctggccaacctggtgaaaccctgtctctactaaaaaatacaaaaattaatggggtgtggtagtgtgcacctgtagtcccagccgcttgggaggctgaggcaggagtgtcacttgaacccggaaggtggagattgcagtgagccgagattgt

SEQ ID NO: 8242 - DNA, 1322 bp, Homo sapiens
acaaataaattggtatgagcatttgcatacaagtctttgtattgacatatgtttttgtttctcttgagtaaatacctagatgtggaataaacagtatctagctattgccttggattgtatagtaggttgtatgtttaaccttttaggaaactgccaaactgttttcccaagtggctgtaccattttacattcaccccagtagagtatgagtgttccagtagctccatattattgccaattcttggtatagccaggctttaaaattttatctgagttattttaacaagaaaagactatcgtggtggaaatagttccccccatttcctatgtcttattttttaaatgctgcaaaaataatattttgtgtgtgaagtttagatggtctcctaatgatttatttattcttttcttattttcgacagtctttgctcacttaaaccgatttgaaacgcagtttataagaaccaatacgttttcttccttttcacttacatatttttctttttttgttctagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggtaagtttttgtacagtgtacgaagatcatcatacctcctttcggtttttctccactgacatacaccaccctgacccctatgagaaaagaaagatcgaaaacaggaattttagattctttgggcttctttgttgagtagacttgaatgtggaaagttacgttgtgttattattatttttgacagggtttttgctttgtcactcaggctgtagtgcagtggtgcaatcaaagctcactgcactgtcagcctcccaggctgaagtgatcctcccatttcagcctcccaagtagctgggactttaggtgtgcgctaccacacctggctagctaaaaaaaattttttgttagctgggcgtagtggcgcacatctgtaatcctagctagacgggtggctgaggcacgaaaatcacttg

SEQ ID NO: 8243 - DNA, 1237 bp, Homo sapiens
aggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagt

SEQ ID NO: 8244 - DNA, 2176 bp, Homo sapiens
gacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctatgattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacat

SEQ ID NO: 8245 - DNA, 1160 bp, Homo sapiens
ttgagtttttacattttgaggtaaaatggaattatcactagcacatttttctgaagccataccaatttgtcctttttatttgtttgttcaaatgaagcagtgcatcaagtatggaattagattaatggagtaaatattatgaatcatacactctctctaatctgacactctttcttctttttttgacctcacgttttgttttctgtctttctctctccgcgtaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggtaaacgctttcctttttgccttttcaaaataaatggacacactgaatgaggaataattttaattgaagcctcctctttaagtagagaaagtaatttgaggaagttttggttgctttttaaattttggtgccttgtggtacctcaaaataatttattgtccatattgccacatttaataatatttctaaactatgaaggattaacttgctttagtttggacaagtgctatattttcttgtggcttgctaaaatgattttattaaacactattctatattatctgcaaatttactgaaaggaaagtcattcttttcaagttctttggaaagaaagtaggaacta

SEQ ID NO: 8246 - DNA, 1227 bp, Homo sapiens
catgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctc

SEQ ID NO: 8247 - DNA, 1237 bp, Homo sapiens
gagtgcatatcgtgcttatattatcaccgataagccagacatgccaggaattcacaacacattaaatcacaatactgaggtcatgatgtaatcatataattccttcccatccccatccttgaggtaatttttcctttgtctgcttattatgtggcttttatttaggatgaagcccctggttttgtgctttgatataaggacttctcctgtttgctgagtacagatctcctgcctgccttaaggctaagtggggaatatgtggttcacagagatgataatgctggttaaggaatgcaaagctggcagctggaggtctggataattgaaaagcgactataggcttagtctttaccttatgtatatgccaggtctccaatcctgtctcccaggttcaatgacatatattgttttgggtttgtaacttaggatacctacctggtttatattctaaatgaattggctggaaactcctttatgatattctgcagcacctgtaataatacccagagaacagctttgctactgcgaaatcttggcttcactgccatccccctccatggacaaatgagtcaggtaaggattcatcatcatcatcagccatgcactggtggcgtgagcgagataaacctcctaacagtaggtttgtacaataaggccatagggcaccgatgcctgtttccataattgttgtaattttatgggctttgaagtgttgctctagatacttactttctcctttcagggtagcgagaggctcccattagaatatttcatatgtacctgtctggtttgcaagctgttgagttgatttattcagccctagtggtaataatgactctggcctctaaaaacattaataaattatttcccagttacctttctatcgtgtcaaactacccttattttgtatcatatatatttttttaattttttgttgcttccatatttctgttttgacctgtgaagccccattcaaaacttagggggaaaaacctttaaaaaatttatgtctgtttgttctcgtgtttgtctattttgtgttttgtattccaaaacataggttaagttttccaacatttctttttcattacctcagagtaagcgcctaggatcccttaataagtttaaggccaaggcccgttccattcttctagcaactgacgttgccagccgaggtttggacatacctcatgtagatgtggttgtcaactttgacattcctacccattccaaggtg

SEQ ID NO: 8248 - DNA, 1367 bp, Homo sapiens
tttacttccttagaataaattcctagaagtacacttgttgggccaagggacatacacagttaaaatttgaattcatacagaatgccaaattgtcccccgccccaagaaaagctatagcagattgcactataaatgagagtatatgtgaatttttctacaccttggccaatactggggattacccttctcttaagtctttgccaatctgccatgtgaaaataaaaccttactttagtgttcacgttttgattactaataaggttaacatctttgtatatttggagttgggtcttgttcctttgctaatgtcaggcatcagcaagttacttgatacttgatcttaaggagaggggactagaatgagtaaccttcagtgccagtaattcattttcaatcccatcctctctttttttcttgcaggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagattctaactccttaaagaccttggtgttaaagggccttatagatttaagtaagatcttgttaataggtaagaacctgacagtgttgattacatggcaaattcattggttgtcctaattaagataaatatttattacttaaaaaaatcaacaaggaaacgagatgatggatggctttgaaagggaagccccagccgggtgtggtggctcacgcctgtaatcccagcactttgggaggccaagatgggcagatcaggaggtcaggagattgagaccatccttggtaacaccgtgaaaccctgtctctactaaaaatacacacacaaaaaaaacattagcctggcgtggtggcgggcgcctgtagtcccagctactcgggaggctgaggcag

SEQ ID NO: 8249 - DNA, 1299 bp, Homo sapiens
ccgcattagagtttttcacgtccattactgcttttaacactcaaaactctagaggaaaaagaaaatatatctcctttttcagatgaggaaactgaggctcagagaggtaaaatcaacccatctaggaagtggtgactcagtccccagtcttaccactctagcatgcttgtcataataaacatggtgagtgacttttttctaaagatcccccctctctcagaggtcatgtcctttcgtaaccagcccttgctcttgaacccccaggcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacagtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaatcataagtgtaattatttccaaggttctacagtcctgaaggtaatataggtatgagtactattgatggtgtttaccattgcaggaaccctatatttagagctcccaagtccttccgaatataaacgcaaagataccaggacacacaccatccctaaactagacatttcccatgactgttatgtagcactctgtgattataagttgaggattttgtttgcagctgtggtctgcgaagggttccaggagtcacaagagcagaccaagaagaaaaatcattgcactatggtgcacagactaccctggagacaggagattttccaggaggattggtttagggggatgagatgagaagcagctggggtccagtttcattaactgaagaggataggaaggaaagaaaaggtgcagtttggcctgc

SEQ ID NO: 8250 - DNA, 1117 bp, Homo sapiens
cttttcccctttttaattagctgggttttgtggtcttttttatatttcttctgaacaaaagatttaatgatagagtttacattagtgatagattactgcataaagtctccccaaaagaaacattttcttggttgttacttggtggtaacatgaaataaaggcataaaatcattcagtcattggcagtgaggccaaggggtgggtggcttgggaggaggtgtacctaggctcttctgtaatttctctctcagctatcccaaatcaacactgcaagctaagtaaaaacaaagtgcttgccatgcaaagcaccttcaagacaagtcccctacctctgtgtactggctagatcaccacccctcccagaatacttgctcagaagagcagtttttggggtaaacactgtttactaaaagatagactgaaagggcattcaaatcacaggatggttcttagaagtgagatttcaatacatcttcagatgaacattcagtgttcaactttctaagttgtttccatagaaacagttgggaagccacagatattgggctgtgagaagcagcgtatggagaagaattgttctaaaagtttaccaggaaagattaggatgtcacagatctaagaagatctgaggcaatatgcacattaggcacatggagagttgatgtggagccatgatctttttcttgagtgagattcaaacacattaagagagctttctttttaaactaaaggcattttaaatttgctaacttctgcctccttttccattgtcttaaactcatgcaggcagtgatcctggagcactgtgcttttgtttttccttccattcctaacccctgcttcactggcttctgttttacagatagccaccaaggttcaaacttgatgtaaacctggatttttttgttttagttttccgtgttcttctgggtatttacagttgccatatatttggtgagggtgtcttctccccagttccccttgactctctgtttttctgtattttcagggaagaagagcccagacctaggggagtatgatccacttacccaggctgacagtgatgagagcgaagacgatctggtgcttaacctgcagaagaatggaggggtcaaaa

SEQ ID NO: 8251 - DNA, 2580 bp, Homo sapiens
agacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcc

SEQ ID NO: 8252 - DNA, 2409 bp, Homo sapiens
gggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatgtggagaaatatggataattatgacatttatccctcattaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagcccattcattacataaaccagggcata

SEQ ID NO: 8253 - DNA, 1100 bp, Homo sapiens
gtaagaaaaaagttactccgagtttcattaatctatggcactttgtccctcctctcccctgcggcctaactcccaaatccccttcagctatagtgaaatacacagacgctgaatatttgggaggattacttaacgttttagctttcctggtttgcttagaacatatgatctactacccgccagtaatattttatagcttagaagatcatgtctgagtcagtaaattccatgttaatatgtgtaagactcaggattaaatcaatctgtaaaatgcctatttgtaatcgaatctagcaattttctttctgaagtaaacagtaatcacattaacaacctagtgatttcactggagatgggaagatataattttatttaacagattttctctctcagaggtgacctaactttgtgatccaaaatcattccaatattgaaaaaaaaaggttcagctaactccattcccctgatatattcagttctcagtgccccttggcttcccaatttaagtcaatgtaatcacaatgcacacaaggctcttccactcagaatcttcttgactggagaatggaaatcattggagaggggctgccctaaaggtttgtagacaaggttttgaagaatcgagctacaatgcttatcaatgtctgtctggaagaaagcctacgtctctttctaaagccagcctgtcaccatttctgagccatcaatggcagcacagcctctccttctgccagagctcacagggaatgacaaatctctgagggaatacaccagagcatctggatgtgggtgtcatcgtctcttcaccaccaaaccattctaccccaatttccctcttctttgtttctagattatttttttttcaactcagtgaagaacatttctcagaaccaagctttttgtctgcttgtcactgaatctatttcccattcaaccttctgtttctcattccaatagacacacaatattaatggttaaaaataacatgcaacaactcactgggcgagaaatttagaaacacttgcctcctatgaacccagggccaaggggagctgaggatagtgtcacattaccagcatgttcaagctagacatcctcca

SEQ ID NO: 8254 - DNA, 1132 bp, Homo sapiens
aacaagcagtaggttttctatgtcttaaacattacatgaaatgtgctgcttgcatctcttctaagatcaatttgtattaagtctacaattaggtggcttctgtttcagttattaaactctctttctcttttttcttaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaa

SEQ ID NO: 8255 - DNA, 1104 bp, Homo sapiens
tgttaagaataactattactgtgctagttttgtaaggctgatgattaagaattttttcctatacttacggaggaaaaagaataaataattaaagctgtgcatagttaaaaatctgacatgagaatgaatactatattttgtcagaggattcatgtgcactgtgacatttagttacaggaatgaatatgagatgatttcatctaccttcttcatgacacaattgtgaggcagttcttagtatgaagatttcaaggaaattctgtgttcacagtgtgcattgcttgaccattagggagttcttatttagtatattgaaagtcatttgaagtttaaagctaaaagctatataccttctaagatctccaaaacagtttacaaaatagttggttgagaaggctattatgatagaaataatattttgctaaggatggataatatgcattaagagctataagaaaaacacctgagtgtgatcattgtggttttccttctcagatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggtattgtgtcaattataagttataaaccatattgaataaatagcaccactatcttcttctaggtttctgacattattctgtattttattgacataatgtggtttatcatagaaagaaagaacttgaagaaagtggttgagcttttaaagtctattactggccagatgtggtggatcacccctgtaatcccaatcctttgggaggctgaggtggatggatcacctgaagtcaggagttcaagaccagcctgaccaacatggtgaaactctgactctactaaaaatacaaaaattagctggatgttgtggtgggtgcctgtaatcccagctacctgggaggctgaggcaggagaatcacttgaacccgggaggtggaggtggcagtgagccgagatcatgccacttcactccagcctgggtgacagagcaagactccatctcaaaaaaataataaataaataaat

SEQ ID NO: 8256 - DNA, 1105 bp, Homo sapiens
gtagcatgattcattacaaaaccccaaatagaacttgccaaatttgatatggtatttggtatttcctagaattcttgatataaaatgatacttctacgtatgttctctaaggtgttttaattctaacattctaaaatagttctttttgcaatcatcattaatcagtgtgacctgtttcttcaggagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggt

SEQ ID NO: 8257 - DNA, 2890 bp, Homo sapiens
atgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggttttt

SEQ ID NO: 8258 - DNA, 1239 bp, Homo sapiens
tcttcttctggattgttttctgtttccaaccatgttttcttatttcctacgagtttatgtgcttggaagcgagcgtggtcgtggaaaacccgtaaccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcctgcctgtcattggtcaccagagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtttggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcagagtcggtgcggtgaggcctccttcggaattatttttacttccctttcacagagccttcgctctcctgc

SEQ ID NO: 8259 - DNA, 1281 bp, Homo sapiens
caaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagatactctgtgttactgataatatgtaaacataatacctattttatggacagaaaaagttaaatatttaaaacttgggtctttaaggaactgcctttctggtacagaatgagaatcttactgaaaacatggtaaaaactacattttaaattttaagggataaaaaggagtaattatttcccttttttaagattgtcatactggctttagagaaactgagaggtgttaagaatagtatggtttggcttttattatttaaaagatgtcttaccttcagtggttacttattccagagcttcttgaactgatacgagttgaatggcaaaagtcattttaaaccatttttaagctataaaagaatcagaagaggttagctttttttcctttctgaattggtgggtttggtgtgcttttatattaaaatatgaatgaataagagtgcttaac

SEQ ID NO: 8260 - DNA, 1461 bp, Homo sapiens
aaaaattattaatgtgatatattagtgaagtgcagaagcttcacttaaaaagtagagctgttagctttcctaaagagatactagaagaaaaccacagtagaattttatcctgagccatttcatgatatgacctgcagcctgcacaagtcagtaactatcttgtctgaactgtttatctttcaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaatggtt

SEQ ID NO: 8261 - DNA, 1254 bp, Homo sapiens
gaaagtggagtaatcatttctgcttcaaggatgactatatgatttcatttatccctaatatagtacacactacatagtaggcactcggtaaatctttattcattctttcaggaggcaaagcaggaacagattaactaattaccagctcagaccaagttaagaaaaataaagctacagattgtcatttcaaaatttgcctctttttgctgtctcactattttaaggagtgcccactatatcactaatatctctggcaagaaagcattccatgtgtatgtatgtaagtgtgtatcttcattttttgctgtcaccacacagacatcaggctttttcacaaaatctgaccccctcccttgaccattttttataactacctggcatgtatcactacagagcttttgttctggtccttctacttggactttggcagatatttgaactcttctgagccagtgctttcctcttcagggatttgtttttaagattttcttccttgccaaccacagagactgaattttatatcccacagatgagtctgagatttccagccccctccgtaaatcccatcactctgtcactcttgacagtgtaattatcccttttgtttcttgctgctttcctgcttgtaatctttgttcctcaacatgtccttcatctgaaaaaaaaggcacccaatccttcttgctttgtcagctctttaatttctcttgtgaaatagtcctcagatatcagctccccacaaaggctttctggaggagaagtggcattttgcttccttaaatctttctgtctattcaattttcatgagtgactgataactagccatcatattaaagtcttctgatcttatatttaagtatgattttttattagatttatgttttgttcagtgtttatgctgttcagtgtatgcatgtgctatgtgtacacttttaatatgtgtatctatacctgtatttgtaaaacagagaaacctaaaggccaaattctgcatcttatttttgaaccaatcaagcagcctactgatgtgagacaaatttcaacaaatgcttaagacacacatctgataaatatataataaaacttgtatgttgacagagcttgtaaatttttaaaattcatatttttccatctttttgttcatttctctgttatttgatgatgatgagtcaggattcttttaatgagataatgagatctttacaggtctaatgtccaaggttgatactgtggtggtgagtgaatcaccatatg

SEQ ID NO: 8262 - DNA, 1141 bp, Homo sapiens
ttgtggactatttacttggaacacatgaagttgggtgttcaaagaaggaaaaataatttccaattatggaaaaagggtttgagagttctctggatctctttatctatggtggcgtatatgactgttgctctgtttggacagggtctaaggatgaatagctattcacttattcctcacttgctttcaagccatgccaactactaaatcctcagatcagctactaaataaaacaagaatatgttattatgtgactcatccttcttgtttttccccctgtatttcaaatttaaaatggtgtcgtgtgaagagattcaagatttccattcctgcttttccctttcctgccaagctcatgacctctgccagctccatcttttccttcctctgcttacagttttggtttgagttctggattcttggagtttatagaacaagagtcatttaaactcttttttttttttttccaaatggaacaagtgtcttaattgaggtcaggccaacacttagtgtgacagaatcttctcctcaccttccttgggacagagagaattcatgccaaggagaatggtgtgaaactgtgaacccaaagagtgtccattgggataaagctgatgcccagttggaggcacagcacagtgactgttttgccaggctctgttgttctgtttggtcccaagccagatggtggcctggtgggtgaaccattggctctggcctttctttcacctcctcaggtataagatgaaatacccagctgtccctttccttgcatgagtgaccctctggaaacagtaattgccctcattgttacttaatgtttacatgattttgtttaaatttggcttttaaaaaatatggtttattggtagtatgaaagtatcaaattaataaaattcaggagtggaatttatttaacaccatattcgagtttaaacagagcttctggagtgagcatgagagaggaagtgggcagatttgaatgagattgaacgagtatagttcatgtattatatatatcattattttgatcactagaaatacgttcaagatgtgcttgcattagagtttttattacgtgttatcttttagccactttgtaacatacataagatggaaatgagcatccaaggtctccctcaaa

SEQ ID NO: 8263 - DNA, 1261 bp, Homo sapiens
gtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacgtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggtgagcaaggccgcaatcctggtcctcgacggctgggactgggctgaaagggatcgggacccgcacgctccagtgccgaagcggtggtgtggtgaggggggagggggcgatattaacatctgagatgagagccaacactggtccggtggagaaaggagtgtgttagggaatccgcagctggagccgagaggacgcttttgtagaaactattacctccaactaagacctctctccttattttatttttattgctatttttgaaggagctggtcagcatttgcctagactctcgggacaacacggtaaatagctttcaaggatttggggaaaggagaaattaggccaggccgtgcaataccttacaaagacgttcgctcttgtctcactggatattcctttgtggtattagcc

SEQ ID NO: 8264 - DNA, 1874 bp, Homo sapiens
actaaaagagagggccagatccttcgaagacatgactttaattccgggtttgttatatagctggagtctttgaaaatttaggccagaaagggacccttggaggttgagttatggtgtaagagaatctagtggataaaacacatgaactctttcttctttgccttttcaatgacatgagtctagttgttagtggcatgtgcagttgctctcttctttcccttaccacagtatgctttacaaacactttttcattccttcattacacagaaatgtagatttgcttctttctttcattaagttgactaatgtgactttttttttttttttttttttttacttatagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaacaatgtttggtttttttggggaaaaactactaatgtgagttttataagtggaaatagccagaaggtttttctgtatcataaccatagcaaaaggtaagccaattaatctgtagtaaacattattttataatattgagattcagttacttgtcctgaatttttgaaattcttatgtcctttactagtgtttcatttaccttctctattcccagattggatagaagtgcttgacatgcctttttaaacaattatttaaataatacatgctagttataagaaaaaaaaaatcaactgaaatttagcagtaagctgaaagatcacttaaaatcctaccactcctcaaaaaactattaaaatcaaatgaccatgaatgcatgttagggcatctctgtatgtatatacagatagatagaatggattttataaaaatgggattactatagtcctgcagtggtttaagaagtatggaattttacctcattctttaaatttgggtggcattcagaaagcccttctaaaaccttctaataaattggatcagctgagtttagacttgtaatttattttttaaaacaaagagggcatattaaatgagtaatttggaaatacttcagatgaataaataacatctctgcaacttcctttttctcctgatcagtcctgtgagtgacccttgataacttttcttaaaagcaatatgagtcaaccaaagaataagattaatttttgaggatttgtgataaccagaagaaagcactgtaggctgtgacaacctgtgagggccgagagaaatacaggggagccaactggtgatccatattggctttcatagagtggtagtatttttgtgtcagcttgttacatgcctgaacctctggattgcagcagtgttgtcattgtaccagcagttgctcagactctaatcagagtctgatttaccctcaataaagttctgtacgcatcagattg

SEQ ID NO: 8265 - DNA, 1262 bp, Homo sapiens
ggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcggtaaggggcccgcggggctccccatcccctctccctcgcgttcagcgccgccgggactagcgcggggcctgctgccgcccagtgccctggctgtgggtccccgaggggttttcgctggggcgggaagcagtggcgtctggtcagccctcaccccaagtaaaggccgaacccggcacgttcgcgccgcttgtctttgcacctaagcttttactcttgtatgcggaaggagtaggaaagggttagattattatcttcctgccttttcgttcactctagctcgctggttggaaaacccaacaacccaaaaaacaaaacccaaaacaaacaacccccaagcaggtaaaaacagataaaaaccttctttctcctccttttaatagaatacttgtgtaatttaatgcagtatttccgtagataattttaaccgtaaccttgaagtggccgtgctcgtggaaaagttgtcagccgtctgtgctcaaaatgtaacactgcagattcatgggattttagagttacaaagatttgttaaagtacctgtattatttcccagttttcatctttttttatattgttcaaatactggcaagaaaccttagttcagatttcttttttttttttttttattgatcattcttgggtgtttctcgcagagggggatttggcagggtcataggacagtagtggagggaaggtcagctgataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagagaatttttcttcagatttcttaacatgtgaaaaatttataattcaaacagcaaaaccatgatcaagagaaggtttaagcgtctcgtttaa

SEQ ID NO: 8266 - DNA, 4509 bp, Homo sapiens
tcatctctagacccctttgattccctggattccatggaatactaggtttatgtatgttaggggctgtcttcatctaaaaattatttatttcagtggatagtagagataacactgaaataatgtgccttcccccaatgaaatattcatgtaaacatagaaggcaggcaaagattgtaataagtattaaattattaacaatttttagggttcagtcagaagctgttttgcacatcgataaatatttattgggtgctttttatgctaggtactgatctggctaattttacatacattaattttagatattctctattttatggatagcatttaccttgtaccctttaaaaaagacatgtgaaatgattgacaaattaaagcacaatgaaaataagatataaatgaaatcagaagtaagttagctttaaaaaaaaaaaaaagagttgggggcagagagcctgttgtctgctacagagacaggccatctttctttttaatgaacttcagcaactttattgaacaaagataacctaatgaacattaaattgatatggaacaagtcattcaatctccctgcctctcagtttgctcataggctctggcagctaagtgccctgtctacctaagagtgttgttctcaggactaatgagacaatgaaagtaaagtggtataattatgggcggtgatggtggtggtagaaagtaactcacaatatttaaagtgtgtgaggtgtggctaacacaactaaatctaagacagaattttataggaggctaggactctagactagtctagtgtcttcattttatgcagagaaaaaaacctaatatttatttagtgccttttaagtgttaagaaacattgctggctctttttatatattgtctcctttaatacttaaaataatttgacaaaggtaggtattgtaaattgtcccttctcccttttaagcagatgagaaacttaagacacaaaaaagtagccagtccaacatcatggctagttaaccaggatccagaatttgaattcactttttttttttttttgagatggagtctcactctatcgcccaggctggagtgcagtggcacaatctcggctcactgcaaactccacctcctgggttcacgccattctcctgcctcagcctccctagtagctgggactacaggcgccagccacaacgcctggcttatttttttgtatttttagtagagacgggatttcactgtgttagccaggatggtctcaatctcctgacctcgtgatccgcccacctcggcctaccaaagtgctgggattatgggtggctcacacccaccgcgcccagcctgaattcactttcatttgctcttttccgccatactgtggaggccctgagagtctattttgtctgagatgaaggttatgtaccttcaaatgttatccccgctgtccatcactgatgtgtttcagtgtcctggaaaactatgtttaacttcttgtttgtgattttattactagtttttcagtgtggtcttcctatctatctatctatctatctatctctttcctgttctcttgggaaaaataaaataactcatttgggaccattacaaatttctaatttccagatttcacctgagtcctcagtaaacactcagtggctctttaaatggcccctaacctcctaaccacctctgtagaggttacacaaccacacccttctctctcaatagagaaaagttggctgacaagaatgttctttatccaaatttttccttctagcaaccaaactcagaattttcttccatttttacttccattctttctgtttgaaggggtaaccattattcttctctctcaagaaatttttcttgcccttttgctatggatttccaccccctgaccaaggctctttaggatgttacttgggtaacactcttttcactttgttttatttcttcaaatcagaaaacttgcttaagccaccccctttctgaaaaggcttcttttaacttgccctcattcttgatattttccccacttcttgctctccagatgtttttgtttttttttttttttttttgagatggagtctctctctgttgcccagggtggagtgcagtggtgcaaactctgctcactgtaacttccgcctcccgggttcaagcgattctcctgcctcaacctcccaagtagctgggattacaggcgtgtgtcaccacagctaatttttgtatttttagtagagacggagtttcaccatgttggccaaactggtctcaaactcctgaccccaagtgatccactcacctcagcctcccaaagtgctgggattacaggcgtgagccactgctcctggcctttccagattatttttttaatagccagattcattgacaccttttgaatgtggctatgatgttaatctttctttcttggcactattgcccaccccttaaaatccccttctttacctggctcagcactgctctcagtggaacatctctgtgcttctctgaagacaactcagtcttgtcccttggctcatcttctaccttaaatgctggtggccttgcttgcttatatccttaatgtgtgcttattctcgatatctgttctccctgagtggccttattctttcaatatgtatcatccacagccacagttgatacctcataaaattttatctctggctgtcttctttccccagcttcaaaccctttttttccatttctacttgcggatgtcacagacttatcaattgaagatattccaaagtaaacacattcttcctccctgccgtttttccccacctcaactcctctgttttccctctattttttctcctcaaagcaagcaaccaactaacctggacaaagctcaccaaaccaactaacctccccaaaataaaacagcaacagcaaaaataccccgttctgtccttcatgaagaccccagtctctgggacactcacccactcaaattatatagaagaccttaagagttagagttttggagctgctgaaaatttcttttcttgatggggtggagatgacgatcccaccagtggatatattgcaggtcttcaaagaagtgctacatgatgtttggttttcctgtttagtagtctataaatggctttgtaagaaacacacactgtctatcccatgatcacagcactatttatgtcaagcttacacacgtgcatctttgcagctaatacatgcctgatgctcagtaaacatttgttttttgatttagaaaccgaggatatgagtacctcacctcttttctgtgtactctattttttttttttttaatttatgaattacattttggatcaaaagaatcttatttctgggtaggaactttttatgttatggcctcctagacatcattttacaggtttttagagagtgtttatttaatcagttttaaattggcagtgataggctctttgacattcagaggtgaggtctgaagtacagaagagttaaactagaaacctgtaatacctgttcaacctgtgctttaaccaagactgggaagtttctctgtaggattcacttgggggaacttcctacacttagtagtttgtactgtcatttacgctctaaaacctctgtattttggtctaactatcaaatggccagaccactttgggggtgcaatttcatcatagttacacaatgagcagttttgaagaaggttcgcaaaagggaaagtacagtacatcctcacttaatgttgtcagtaggttcttagaaacttcaactttaagcaaaaggacattcagcaagtccttgaaccttgttttcctccttgtcattttgttacgaggttgatgaaaaaaatggttttattgtacttcatttcattttatagatggcaactgaggcaaaaagaaggcagtaactgcccaaggtcagacaggcagtaagtggcagagttgggatctggctcccaagtccctgttcttcagtaacattatgctgcctctcataatgttctttttttcaataaactgtgtgtgggcttctaaaatagtaacagttctttatataaaaggggaaaaaagttttaaattagagcagggttgaagaaagttcaacttaaacttaacatttgactgaattttatctgactttttccatgtaatattgacgtcatcgaaacatactgtagttatttaaacgtgtcgtggttctaaatgtcttgcatctaatgttatataactaaatggccaaagataacagtgttacctcgttatccctgcttttgcctctttttatttgagtgtctgtggctgtcttttcctgcgggttttttgcgcccgtactcatctttcacacattattgattatcacgcctgagtgatctgccacatcccaaatttgtccttttataccttacctgactagtggctgtgatccaggaactttcctccctggcacctatgcaaagatcagtggctgccagctctaagttccagatcatgatttctctactctctgcaatttactagt

SEQ ID NO: 8267 - DNA, 1313 bp, Homo sapiens
tattttaggattttcatggccatgcttgtcagttctgttgttacagaatgtcacccttagttactttgggaaatggtaattaattaacgttgcaggtgtcaaagtaatttcctctctcttatttttcagctatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaatcagtgttagaatttttgttctttccatccaaaattgaaagtcttaagactcaagagacctctagaagaaaaggtactctgttaattttataatcctagacaacatcttaaaagatccttgtcggtccaaccctcccatgtcaaagttgaggaccttgaggctcaaagagatcaattgagttggccacaatttaatgacagaattttgaccagactatagttttttctgactttttctctaagtacattacattagctcattaccactagaggagtttagttttgtgaagtcttttaccacgtttctatttgct

SEQ ID NO: 8268 - DNA, 1170 bp, Homo sapiens
gtgcaagaaagaattcagggagagtccgcagtgcaaagtgaaagcaagtttattaagacagtaaagaaataaaagaatggggaggctctgggtgcctccccgggggcccggtccctggcgctgccctggcggcctcatggccggctccgaggtggccatgccgctttccccgtcacgaggggcccaggaggctcgcggcaggggctgccacatgcaggacctgccccggcgttggggtgtggggtcccctggcctggagcgggctcgtcctggcgggcctggatccaagcacagtctcagcttttggagccagcagcagccgggccgaattcagtttttccggaattcatttgttctgacccaagtttagccgacaggatcctggcgatgcagcccaacaggaagcaaagcacagggaagcagaaatgagaaacagtatcttaacccaagttttggatcagtcggccgggccaggtttaagtaacttagcacttgtaaagcctgaaaaaactaaagcagtagagaattaccttatacagatggcaagatatggacaactgagaaggtgtcagaacaaggtttaatagaaatcctttaaaaagtaagccaacaaacagaaaagacaacaacagtgaaattcaacagaagaaaagtaatggactctgatgaagaagacgattattgaactacaagtgctcacagactagaacttaacagaacaattctaggacagaagttaagatctgattaaatatttagtttgtttattgtctatatgccttttaaaaaataaacttgttatgcaaaataaaaaaaaagaaataaaagaatggctattccatagacagagcagcccagcgggccgctggttgtccatttttatggttatttattgatgatatgctaaacgaggggtggattattcatgcctcccctttttagaccatattgggtaactgcctgatgttgccatggcatttgtaaactgtcatggtgctgctggtagtgagcagtgaggacaaccagaggtcactcttgtggccatcttggttttggtaggatttagctggattccttactgcaacctattttatcaaggttttttttttgtttgtttttgttttttgtttttttttttgagacagtctcactgtgtcacccaggctggag

SEQ ID NO: 8269 - DNA, 1211 bp, Homo sapiens
aaatactgcaaaatttccccaattctttgacatgaaaagaagtaggatgtggcagcagttatattttcagattaatgaatagaagagatttcaggtcaacaagtgatttgcagagctataaagataatgctttgattgtgaattatttacagctggaaactcttactttcttatgcttctttgaactgtagaagggatgagatgtgataagctgtgtgtgtgggggtgtgggtgtggtttgttttctgtaagatgtagtattgagttcatgcctgccaaaagttgcttaaattattccatttctgattttgaggtactgtcgtgtttctgtcttgatttgtacttcattgccaactaattaatttaaaagcattgttgttttctcatggagaatatggttactatgctttgttcacatggagcagaatgtcaagtggtaatcttaattaaatatttataagatcatattcatgttagtgaatttctaggaataacacagccttttttcttcttttgtagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggttggttttgtcatttctttttttcgctccctgttttcgttagttttattaatttataattgctagttaggcttttttgctgaaagtaatttgggattatttttacacaggcttagttttttcaagtgaatttttaataattatttcccatatacttgatagaatcaaataaaaatagggtatgtgctggattttagtttgtttttagatacgttattttgaagaaattagacttttaaaagtatagtaggtgacagtattattaatgaatacagtgtattccagggttctgatgttttgagttgagaacatttagaattagcactttcttgattttcctttgttagaggatcctaaattattcctgacgcttaaattaactggggagactattggtaccaggattagtgtatgcaattctattaaataacaacctgaactcattatttgtgagtgagaattgatcatctttcccaggtcttgt

SEQ ID NO: 8270 - DNA, 1089 bp, Homo sapiens
acaatacgctgtctcaaaaaaataaaaataaaattcaggaatccagtcattgccaggatatctaattatttgttgcaaaaacagcttagtgcttctgctataacaatgattaattcaaaaccagatttttctgggaagaagatcccattatttttgtattgcatatagtggaaatagcagtaaactgggaggtcgtgaaacttgttgcattttcaagctttgtctaatgtatgtcatcttacttggcaacttacttcgtaaagtgaaaagactactagtcccttatgcttcctttctggaattagttctattgtactacttatttacttccgaaaatactagatattcactcattgatattcttctcgtgccctacacagcatgcctgacgttatttctgttttattttcttttagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattacgtaagtgttacactgagaaaatctggtgtatttcatggttttaaaagatatcttagacttttatgcaaatccactttgaacttcaactcctcttctattaaaagtaacaaacaggtaggatgcctgtctgtcagtgagagtgagaattcagtggcacatgtttgtagtagctaagggagtatatgtggccttcaaatataaactgtataaaattagatttgggggctactctgattctcttccaaaataacatttaaaatatagtaacattggtatttctagaaatattttagaaaatttgaacatgttaaaagtaaatatcaagtgaaagttaagtaatctatctactccaaagtagtgtgtgtacctgagctgggaggtagaggctgcagtgagccgtgatcgcgccaccacacttgaacctgggagacagagtgagaccctgtctcaaaaaaccaacaacaaaaaaaaccaccacaaagcaat

SEQ ID NO: 8271 - DNA, 2038 bp, Homo sapiens
ctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctga

SEQ ID NO: 8272 - DNA, 1696 bp, Homo sapiens
aactgatacagaaagaatattttgaaatatttaatctcatgagaaaactgaatagctggatttttaccaaggtgcttgctttgttttttttttttttttgtaggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaacttagaatttatgtttttatatttttccactaatatcattatcacttctgtaattttcagtgtggtcatcattaactcaatacagtcattcattttattgacttgtgatttttctggtgtcatttggaactttatatgattcctgaagaaattccatttt

SEQ ID NO: 8273 - DNA, 1101 bp, Homo sapiens
ttgttactttttttttgtttttgagatagggtcttgctttgttgcccaggctggagtgcagtggcacaaccacaactcactgcagcctcaaactcccagcctcaagcaatcctccctcctcagcctccttagtagctgggactacaggtgcacagaaccacacctggctactttaaaaaaaatttttttatagggatagagtcttgccatcgcttgagctcaggctggtctcgaactcctgagctcaagtaatcctcctgcttaggcctcccaaaactgttgagattataggcatgagccaccatgcctactatgtcttataatacatcatttaacttgtttttgctttgcttagctagtgagttaatctcaaaactattatcataaaagtttaatggtctataagtattagaagtcttatatatgtttgtctcattcttatcaaacttctataatagtcttacatgtttgtctgattcttaactttcttttcctagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggtatgtactaaaaaaattaattttgagttgaagaagtgctttgtcatcatacctttttaattcttttaaaaaataatttataatcatacatatataaaaatcaagtgcatttttgtttgatttcttctatattaatagaaatttaaagtttcacttaaaggaggaattttatttattttttattttagattcaggggtatatgtgcaggtttgttacatgggtatattgtgtgatgctgagatttggacttctaatgatccatcgtccaagtagtaaacatagtacctgctaggtagtttttcagcccttgccctcctctctccctaaaggaggagttttaaaaacttctgagattaatccttttatctggttcctgaaacataaatttaaaaacatattgtactgaacattcaaaatcctctc

SEQ ID NO: 8274 - DNA, 1214 bp, Homo sapiens
ctcttgtttataattaccaactccttttaccaccaagtgagcccaaataggaataccttcataaagtaatagcaaagtaattagggaattagcttccttttgcttcaaagtctgatactttacttaaatgatttaggagattgttagaccacttctctacaacataataaaaataattatcatgtattaaatatttgtgtaccaggtactgcgtctagaactcctaatatattatctcactagctcttcataaaaatactatgaaagttagatattgtccccattttacaggaagggaaatggggatgcaggtgagtatcttgtctgaggtcactcagcaggtaaaaggaggacctgagatttaacttaggtctatatgactcaaaaacatgctcataaccattctgctatactacttcaagtttgtctgtaattgatatggcgggcaacacccagaaatcaatctggaaacctaaagttgtaatttactctgtctaatcattgtatccgcgctgcctcccatagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaaggttaacttttttttttttttttttgctagttttatttcttctcatattttaaaaaactagaatgaattcttgatgggacagtgctttccagtaggcttagaggtgaaactggccatttctccagtggaatgggaaacttgcaggtggatcattctttccctgtgttctgtagtcttcaaattaaacttttattattcagacatttttttccagttattgttacagcaacattgatcatgtttagaaaatgagatacttcctttacctacattaacaaacagttaagaaaaaaaattcaaactccttgccaaaggttagatcattttcctgccctagtgaacaaacctttcatgattcaagaccttatcaaacatcaagtttatcaattataaatagaataatagaataattagaataactctagaagggattgtgctttttgtggatgttgcttttcaatgattcacgtctgaacaagatatttacaccaa

SEQ ID NO: 8275 - DNA, 1113 bp, Homo sapiens
atgaatatttcagaaccaagaggaatacccttgggtgacatatttatgggcagctttcctctttatgccttgccaactcatctgcttgactaagccttcctcatccagctaaaactaggaaaactactgcagacacagatgccccttggtaacgtctaatctttctttgtttctctttttctccatttaatcaagatagaagaggaatgagacaagtggaacaaagctacaactttaaaatgcataacccactccttggttctgctgcttggttgtacattacagttctgtctggccagttgcccacattaaaagccaaacaaatgtgcttctttttttatatttagctttgactttacgtttaaaatttatgcattgtgtttaattaccttttccgtgttgtattttctttctcttttaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggtaaggcatattattgtctctttcagtaaatcagtgtgtcagatagttagtacaaaaactcagatatttgcatcagttggagtaagatgatgatcatttccttaaatggaattttatttaggttgaatcttatagatttagatgaagcaactataaaaatgttttatcacatgtgaatgattgcctaatggtataaattatcttgttttgtcagcacaataaagtttattttattggcattttaaggcaccatctttatgttggatatttgtatcaactaaatagtggtaggtaggtcggtcgatcgatcaatcggtaggtaggtaggtagatagatagatagatagatagatagatagatccagcattttggtgtgtagaatcttatacttcatagctactgctacttgatggaaatttatttagcacatatacgtattagaagattgtttaccaaatacactactatgggagattttgagcaggtaatattttgtaaatgccagttagcag

SEQ ID NO: 8276 - DNA, 2814 bp, Homo sapiens
cagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctatttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactgtggtttcttaagaacatgacactaaaaaaaaagtgttttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaactctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctattttttaaaaatcagactcccagtttgtatattatgttattcaatagacattttctgagtaccccttgaatactaaaagtcctgtgttgaatgtgggagacccaggagaacaagatatgtgccatctgctcattaagtgcttagaatgttaacattgcttttaaattcttagccgtatttccacataacttgtcctgacttacactgcaaacaaatggtggtagaagaatttgcagtcgaaacaccccaacctcttatttttctccca

SEQ ID NO: 8277 - DNA, 1290 bp, Homo sapiens
atttaatttgaagactcatatatcaaaatttattaaagtgtatttaaatagagcagtgttcaataaaatacgtatataataaaattaaataagtacttgttacttacaaatatctaattttctcatagtgtatgtttgcatattctatgtataaaacctaattcaaaacataagtattggggaaatgtggacctgtaagtgatgaaaattagattagggaatgagttcaggcctatcaagttttctacaattctttctgttggaacatcggacctttgattattctcttttttcccccctttagagattagttcttgctctgtcacccaggctggagagtagtaccgctgtcatagctcactgaagcttcaaactcctgggctcaaacagtcctcccacctcagcctcctgtctttgatcatttttacttacagtttcatgtcttaatctcgatgctttgttgttctggcaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgcttctgtttctgggattccttccttaatgattcctgaaagatttcagtcagtctgccaagtcattcttaccacacgtcataaatgtccctaaattccaacatcatctacactcctccctctggatgagacaaaaattcttttttgcaacaggtgccacggtttgttgttgttgtcctgagaatatgattatctttttaaggttataactgaagaagttgtaacggatgtcaatgtatatgacatttacaaaggaagcccgttttaaaaggaagaacccctaaaatggaaactttgttagaattctatttaataatgaaggaaaatgaaagtttggtctggattattcagattgagtctacttggagatagcataacatgtgaatttacagggaaacttaggtagacttcctttaacaaagagttccaaatttacatgtcatatgtagggg

SEQ ID NO: 8278 - DNA, 1188 bp, Homo sapiens
taaaatggaccaggaattaattatttacttatttttaaagaaatgacaaagcacatcctccaaatgggtatgattgtagggaaataggaactcttttaacaaacactgctgatcaaactgttaaactgggacagtctttctggaggttagtttgataataggtatcaaatgtagaatgattattagcacaagctgtgaagtcagactgtaccactgattagccagttgtgataagatgaatgttgtttcctcatctgtaaactggagatatcgagagtacctattaccgtagggctctggaagggattaataaaataatatgagtaaagcacttagcagaatttctagtacatatgaattacactctgaatagtttttgctgctaattgaatgtacatactttttcctccaaattccaattccaggaaagaaatgagacaaatgggccaatagtgaagttaaaagaacccacttaaatgtcctgtgaaaaatagaatatccctaaaaaggattactatgcaaccattacaaacagtgctgtgacctgtatttatttgcatgatcaaatataacaatgtttttcacttggatattaagcaatacacttacttaccaggtacctatgatgatacgcagcatggaactggttgtgggaactgtaggctttctgcttgcagagcttacagtctgatgatgtcaacattttaaaattgataagttattaagatgcataataactataaatcatgtatgaaagcagtatttacaagggtaatatgagcctcaaaataagaagcacaggaaaaactttgggagcatgtgatctagagacttcaggaataacccttaaaccacacatgaagatttaatggacataaatgctgcagaatgtttgttaaagacagatccaatttttattagaagaaaattttagtggaatgtataacaaattccaactatacttattatctttctttgggatgttaagcaagcttctgtataccttagttttctacttagaatataaacacaaaccaaattttataaagccattagaaagaaaaacaaagataatataaaatgcttaacatagtgcctacagatagtaataagtgtatcatttatataggtaaaactctagaattatatgtgtcaaaatgtagtgattatctacaaatagtgataatt

SEQ ID NO: 8279 - DNA, 1168 bp, Homo sapiens
agttatttaataagtggtagctattatttttttactttataaacaaccaacttttagctagcagaggtcgttaagcttttaaaattatgagttggttttcaaaaaggtttggaaaaaaccagtatcttacaactagataacataaggtttatctacaagttgacaatgatgaagtcgtctgaaaaagatggaaaaattgcactgggaaatagaacaactttcacactctccttgtaataatttgttcctacagcagataattttaatgctcagccgctttttctttttcttcactttataaccaatcattgtgtgtgtagctatactgcatcaacattttcttttgcaggaatgccatttttcttccaaaagaattccattccagcatttcctctcatgtttttctgtctctcttttttaattgcatgcagtgcatgataatttcttttctttcatgacatggcttagcctcacagacagctgaatgttgtcaccacttatttggaaacctcagggaataattgtgttaccagcgtctgttctgaatgttttctcatttttctccaattttagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggtaattttatagaagttatttcattttttaaaaaattttctctgaagatttagtaacaaaactaagtttcaaattgttattttttgccaaaaacttacaaatatttatttatattttaattatctggattgagtctagagtttatttcatttagcagcgaggattatcacaagaattgtgttagttttaaacctatttattgttagaaatcttagaaccttatcatatagtaaataaaacaaatatctgtgttcaaatagaagtttaaaatagccctgaaagaacagcttcgtttcctcagtaatttagcaatttttgacagatcacatttagaaatagtagaggactgtattacagatacatgtctaaggagatactttatgtaatttagctctgctgtttct

SEQ ID NO: 8280 - DNA, 1239 bp, Homo sapiens
ttattcattctttctatttttttgtacccattagccatccccaccttccctccagcctgccactacccttcccagcctctggtaaccaaaatatttttttctttgggaattttttttgtggttatatttgtcaaccagtgggaaaatgtcatcattatcatctaaccattttttaaaaatgttgtatcccagagaaaaaactttggggtgatagtgatgtttgtcaggtggtaagtcatcaaacaaataaattggtgcaaaatgactttgcaattggtaagtcttttctctcataggaaaaatgtatggttctgatttcatggtcattttcaattcttatcagccttagtggtacttttgtagcctacagcagtagaagttggatagttcgtatacaagtactgtgtatgtaatatcagttacataattatttttgaaaaaattggtacatttttaaagaatatcttatttttttatttatttatataggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggtatgtttgtgaaaacaacactcggtgtccctgaaaaagtatgagatagggagccgtaaacctatttttaagtgtcagctttactgtttcctacctgtttgatcctgcacaaactggacaattctgctggaactttgtattttattgcatgtaaaaaaaaaaccctctgtgtaaaactcaaataagtttgtgtacaaaagcagtttttaactttaaattctacacaaatatttgtcattttgggaattattaacctgccaaaggctagggatgtgactaagtatagattgcttcaattacattcaatatgtaacacattttagaagttgactctctttttttcttttaaagaacagtgccatgaagtgtttcttttactgctttaattagctggtaagagttccttttaaaatgcactggagtaggaaatcctaattggggaactcatgacaacagctgccaggttaccaaatccatcaggtacttctgtcctcatcttagttctgacatctcagcaatagtgacaccattaattattttcgccttgaaattcctttg

SEQ ID NO: 8281 - DNA, 1176 bp, Homo sapiens
ttgttatattttgcctcatcattgctttccttagcctgcattttctgatcatcttctgaatctgcatcttttctctgctactttcctccacagcaccttacccacagggacctaggatttacctgtgtcccagctccccctctctctcttgtggttcccttcatcttaaaaagtcctgtctcctcctctcggaatctagccttacccctcatcattctagccttgtcagcccagttctgaggaaaagtgtttctttcagtgaagagctgttcctggctgcttctggtaggatcacattatgtcagctttttaatccctttatttttcatgctgtaaaaaattattgggtattttatacaagatgcctttctattatttttcttactggtagtcagagttaaataattggaattataaggatataattgaggattacttgatggctaatcatgaatattctgccaaattattttatatattaaaaaattatataaggacatagatctgggtatttctaatattattagattcttattactacagtttctgttttagatgctttactttctttcccttcataccaactccattcacattggacctgtgtcatcatgttgctaaaccatatgattacattagtaaattattctgtttgaatcagtttaagtctcattttggtgatattcttttattatctttttttctgtctgttgcattaattattaaatttttctgctctattttctgatatttcaattatcactacaaatttacattttattttctggcttttaatatgcttcgtataaagatcttagtttcatttctatgtttagtattgtatagtctctaaaaataatgttcagattactataagaaaaaccatttttttgtttttaggaacagaatgggactatacatatgctaacctttgtttccttatccaagaacagctaaaaatgtaaaagttaattagttcctttttaagtcgttgtggtaaatttggctgtatgcatcttacgttttgaaagggatgggattaactctagtctgtagagcactggcttcttacctgtcccctgctttctatgattgtttgaccatagttgatctactggcatggtcagaacaataaaataaggtagggaaagaaatttaaaattaagccgtaaaaaa

SEQ ID NO: 8282 - DNA, 1296 bp, Homo sapiens
ttgttaaggacttctataagtaatgaaccatactaggaatagggcagtgttcccattctcagagactttccaatctgttggacataggagagattccctgtatgtgtacattccctgtatgtgtacacacacacatacacacaaatgtgcaaagattgtgatacaaggcagactgtgagaaatggcaggtatcaagaaagttatatagaaatattgaagacagaatgtataattaacactttggatcaaggaaggcatgttatatgaattaagggcaacatgttaacattagtggttctctttgtttaaatatagaattaaaattatagatgttagataaaattgtattcaaagatggttcttttatgtgaagaagttggtgttttctttaattagtatttaactcatgattttcaatttatctcctgttctctaaagatagataattgctttttttcccatttttaaaaaaaatttttggcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggtacattttcttttctgaatttttccttttgaaaaatagggcatttaagtgcattaaggaaatattttttaaaattgtctttgtttgagcaactatttggttaacttagaaactttctttagctagggtttttgtttttgttcttgttttccctaaaaagatagaagtaaatttctttatatttgcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaacaattctttgttctttacgttgttcattatttaatttaatatattatgttttctataaagaataatgtcatatatgcttgatcatttttccaaaattgccagctttaaaaattctctttctgctcttgaaaactctagaaaatggtctggatttgaaaacag

SEQ ID NO: 8283 - DNA, 1099 bp, Homo sapiens
aaaacattttgctaacattagtaggattatagttacttttcgtatcgttctcttcgaacctgcctaacattgcagagcaagtagggtgagttggaaagatttttcaggttctcatattgactattttgcttttcatttttattcctttctcctaacaacaaaataaaggaattcagacaaacatgtcatgtgataattatatagccttgggtaatacattattattttttagttttaaagtactttaaaaattggcagagtatttttagtatactaagatttgaacagtttaaccagtagtgtcgggatttgattacgctgataaagatatgcaagaaataaagtaataaaagacaaaatgtaggtttggaaaattcaaattgtagttttatccattaatcatatactttactttgtgcttgtcattgtgataattacataaagataaataaaataacacacctagcccttaaagtagtagttctttactttttaaaggtcaggggtcccttgagaatctgaaaaattgagaatctcttcctaagaaagtgcacatacacataaaattttagggaatattctagttgtcttttcatccttgaaaccccaattaaaaattcatgtcttaaagaactgagatgatgatcatgctatatgagctagttaattattaatgctgatgtggatattcgtttaaataaagcgaaattttagaaatcagaagttaaatttatagaaggaaaaagtatattttctgttgttaggaaagcattttccagtaatttgatttttctggcaccctaactaagggaagttggctttttaaattttactttgttgcagaagattaaatttaaggttgagttccactttgtttgcaatagtttgaaaaagaatagttaatgcagattttttttttaaatttttttccttttaagctttgtgtcttgtacaatgtgagtttgccaaattttcttcatctgctacagattaggtatgccattgttgctgccatgtggcggcgcaccccgtgcttcttaaacgcactgactggaggtttatcgcatcacttgttcacatgcacggagcctggtaacag

SEQ ID NO: 8284 - DNA, 3993 bp, Homo sapiens
tattcaaaatatgcaactacaaatttatcctctgagaaatcttctgaggagtctaatgtattccaaatgacttaatattctcagacaaatgctttaaaatacttggattatctcaagatttttgaagctaataaagtaaatagaaacacaggccattttaaatggtaaattctagttacataaatataatcttaaagtatgtttgtatctgtaacagtgttagaccagatttggtttctacctccccaatgttataaatgttcacttttgtttttataaaccatattactgtaagatcaatagaactttgcctagttaagtgaatggaaccaattaaacaactagtagctttttataatgttagtgtgaacttgaaaaattgtttttggtggaatttttgtctgtggttagaacattttcataaaacagataaagaatgtgtaatactcttaattttttttttttttttttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaa

SEQ ID NO: 8285 - DNA, 1162 bp, Homo sapiens
tcaatttatcttccaattaatctactaggaagactaaagaacatctcattgaggaatataggcacataaaaacattgctaaaattgcaatccctgcctctaacttcccaacagtcacattggagttgtatcacctctaatttcatttgattcaagacaaagacaaagtagccatattcttttagaacaaaaatgaacagccatgtggattttttacatagtactcttcttcggcaaaaagccacagaactttttttaaaaatcgtttccaaggatgaaagtgactttgccaagcaaagtggcttcaaaacaggcctcaaaaatactaatagaaagacagatggttctactaagagcttggctgccaaagtggaaaaaaaaagtaaaaaacaaaacaaaaaaaaaaggagtgatgctattgaagctgactgcaaagttatccgatgactacaaatacttttgtcccattgcaagtgctaactctgcctccagggctgatatagccaaaatactaacttccccacatccaatccccctgtattcctacccctcctaaatgaaacctgtcagtgccaagccccagaaaacagcacaagcatgcacttgattctgactgactgctctgcagaagcaaaatattgcattgaagaactcctatttaggaacagacctacaaggaaaattgcttttcttttcaaaactgcctgtcacattttctttttctaattcccctcttcctcctcctccctgtcaccaaagggcccctgggccctatgagtttatatgatacaaactcaatttgtataaagaaggcaagaagcagcaccacagagaggtgaagatagtttgcaaggatagagaaataatccagtcaagacacagtgcaattttctctccaaactactactacaataatacctccactttatttccttcagggcaactgtcatttctttttaaccagattgctactagatataatagaaactgaaatattatatggtcactgactctttctttcaatggctcatttcactactgcatttttacttttgcatgatgtgtttattgttggcaatattactaggatacaaccactttcaaaggatatagaattaagacctctgttactttaacacaataaaatttcattcttaatgcta

SEQ ID NO: 8286 - DNA, 1188 bp, Homo sapiens
agctgctgtcaaagacactttggcccgtttatccagtgctttctcccctcctggagctctcagcttcagcttcagcttaggaccttctctccacactgcatgactggagtcttgcagggatcttggctctgacgatctgtctacatttcagagtcggagaacataggacagccatcctgccttttcccaactccttgtcctcatttattatcctaggcaggcttttcccacctcccactccctggacccagccatgtcctgctcctctcacccattgccacttccaggtggataataccaaactgaatgctttataagtggatgaaagagttaaaggctcacaatagatgattactgaacactatggagaaattaagcctcctttttaataaatgataagcccttctcatgtctggtgatccaaaactgtatttcatgaggctgaccatgcatatatcaaatcataaaactcttacaactcataccctgactgcattttcaggggtatctactatatatttcaatcttattattaaggcagtggagcttcatcagtgctcactacataagaaatcatatgaaagtctattataactttaaaagtacacaagaaatgtggcttttgatgcctggtagagggggcatgtagacataccggaaacatcatcagctctctatcccattgaagtttgtttgaaagaaactgaggatgcaggtacaaaatggctgagtgatttttttttctgaccaacggagccgctcgttagcaacttgaaaggatgcctagatccaaaatagtattaaacaagtgtttcttcaatatgagatcattatgtttctcttctaaatccaaatactaattgcaaccttgctgtgagcatacaatattaaggccatcatagccatggcaacagaatgcaacatgaagtggaatcctatcatctgcacagtgttgttagtggtttgggtggcagacgagcactttcttacaacatcgctatacaacatcgctaatgtccaattccacagaggggattgcattgcatacctttaggcaattttgccacacaggttctgttatctttgaacattctgtgtatctctataattaatttcaatacaggatggcttgttaatccacagacaaaaatacaagcacaaattaaaatttcaacaggcactttacaa

SEQ ID NO: 8287 - DNA, 1110 bp, Homo sapiens
tttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaa

SEQ ID NO: 8288 - DNA, 1140 bp, Homo sapiens
atagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatc

SEQ ID NO: 8289 - DNA, 1099 bp, Homo sapiens
ccttggatacattaaaaggtgttagataagagcgctcacacttgctgctcttctattgcaacttgacagaagttacttctctaaaccttagtttctcatctgaacaatggaaataatgatagtgtctatctcatagtattggtgtgagatttaaatgaaataattcatgtaaaattgcttggtgtgtggaaacatagtaacttttaactgttctcattaacttggctatttacctgtgttcttctatcattacatttcaagttaaaatttcaaggtttcacgttgttctctctccaatgaatgcagttaaatcacttagattttctaatgagttttcctttaatgttatgcagttgactagagagtgtatatatattaagaacataataccttcactatgtccacatgtgaattaagagcttgaggctatcagagggtagaagatgagggagtggggatgaagtatgtttgtaacctgtgtattttctctttcttaaaggaattacggctcatctctttttgcccaatgtgaagcagtagataatgggtgtcagcaggtcctgtggctctatggagaggaccatcagatcactgaagtgggaactatgaatctttttctttactggataaatgaagatggaggtaatccactcagatttcactgtgtgcatttctcagtcattttcaacaggaccagaaagacaagagctagaaacttagtacaagggagtaagtagcacagttccaaaggctaagtaaggactactgtgcttttgctgcccaaatagacacaagtttcttttttttctttctttcttttttaaagaggtggagtctcactatgtcacccaggctgcagtgcaatggtgtgatctcagctcactgcaccctggttcaagcaattctcctgcctcagcctcccgagtagctgggattgcaggagcctgccaccatgcccagctaatttttgtatttttttttttagtagagatagggtttcaccatgttggtcaggctggtcttgaactcctgacctcaggtgatccaccggccttggcctcccaaagtgctgggattacaggtgtgagccactgcaccc

SEQ ID NO: 8290 - DNA, 1250 bp, Homo sapiens
ccatgtcctgaagcagtcacttaggctatgaaacagaaggatgagttagagaagtaaatattatattttaccccccaaagcctaaaaccatgtctaggttctcccctttctcaattcccaatcatgcaaccttgaaaggtgttatatagatagttgttagaaatatgtctgtcctccaaaaccctactaacacgcaaaaatggacaaatctagcttttttgctaaaatcctaacaactcagaaagcaaagcaaaatgaaatgtatgtactccattctcaggatttccttcttaaaaaccactaggctttgtgtaactcaattttaaaagtatggtaatagctcctgtaattcgatggcttcttctgggagacagatataaatctattctagactttaagactggtgtccacattttaagttacagttgtatgtacttctactttgttgcagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggtaagtaaatctgtgtctctgtctaaaggaaagacaccttcatgaccatttagttagtgccatttcacttcagtatgaacacatataatacttttcaaactttaatgctcattgtgtttcatggttaattttcagtttaatctttcagcaagccagctgtagtagcttttcctatataaacgcagtatgaattcagtgccctcgcttttagatgtgctagtttaaaggatagcccatggccctttgtaagggagaaacactggatatgatatctagggaagaactgaagtaagaaactacaacaagcatcacatcggtgctttggataaacttcccctgggcgctggtctctggctgcaggctgacggctggcattaaaaagcatctggtcctgggacccaggctctcagttggctccagggagtcatgtctggggaaggtgcccgcttcactgaagtgctgtcttcattgccacagattgtggccacacctgctgccaactggctgcgggacagccctgctttggctctgtcaggccagtctcataggccatatgtagctggcaggaaataaaagagcatttgaaaagtgttggacgatttcaggggtggacttggccatgagttgggaatgcc

SEQ ID NO: 8291 - DNA, 1128 bp, Homo sapiens
cttcatgatttgtgttttacatctcctacttaagaatcctttcctaccttaaggtcacagagatattttgtactttttaaataaagtcttagtattttgtcacatttaagtatatcatctaattagaattgattggggggtatggtaagatgtagggatctaatcttatctttcacatgtggatagctcgtcatcccatcacaatttttggggggaaaatcagaaaaaattgtttggttttattattactttaaaattttttttattggtaccataaattatacatatttatgaggtacactgatgttttcatgcatgcatataatgtgtaatgattaggacaaataagaaagaaataaataaaaattaggataattaggatatccatcacctcaaacatttcttatttttttgtgttgggattattaattttttaacagtttaaatgcttcagtgaggatcatttattattgccacattgtgagaaaattctgtcatttattatgtttttcattctttcaggtatttgacaaagaagagctcttagagtgtattcaacagcttgtgaaattggatcaagaatgggtcccatattcaacatctgctagtctgtatattcgtcctacattcattggaactgaggtgcaaactgactctttattttggggtactttgctgggcaagttattattgtttattgttgtttgaaacttctagcatatagtttgcagtagccccccagtagcatcattaatgacttcttccttctgattgtcaagattagaggtagcaaacattttctgtgaagcgccaatcagtaaatattttttggctttgtggccatatagtttctaataagaaattagatccctacctcttaccataccccaaaatcaattataattcgattatatacttaaatgtgacaaaatactaagacgtttattaagaaatacaaaatatctctgtgaccttaggtaggaaatgattttttttttttgaggtctctctctggttttttttttttgcccacgttgtcgcttaggctggggtgcagtgatgcaatcacggctgactgcagctttgacctcctgggctcaagtgatcctcctgcctcagcttcccaag

SEQ ID NO: 8292 - DNA, 1180 bp, Homo sapiens
gtggcttaacatagtatggtcttgagctgcctggtttctgtgatttagggactgaaccagctctggtcacatctggattatctactatccagcattcaaatgaaccagattacatgaaaggatatgggggtactctttgggggccacggtgccacaaggcctttggtttcgatctccattgcctagggaattaacctgtgctgtgtgattctagatgttttcttcctgctcccttaaataacacctaaatgtgttattcagcagtgtggctcctgctaagcagaggagaactcggaattcctaccaaattctgataataaaataactttcctccacctcaaccattgtttttaccagtcctgtcaactgttagctttcctggatttaatgatctcaagttgaggtcaatgtcaacagctttatgggatgaataagatgaacgcccataggaaagtcagtctcttgaacacgggttgttttcttttggttaccctctaagattttttctctttgatctccagttatttgaaggattgaaggcatttcgaggagtagataataaaattcgactgtttcagccaaacctcaacatggatagaatgtatcgctctgctgtgagggcaactctgccggtatgtaagtgtaggagtttcttttgtgtttcttttaatgtaacgggtcacggtgttgaccaccaaataaataatttctgaatagttagataaatattcagtacaaaccatatgaacattaacattatttctgatctactttagttaggtaaaaatacaagaaaatggccgggcacggtggttcactcctataatcccagcactctgggagactgaggtgggtggatcacttgaaaccaggaattggagacaagcctggccaacatggtgaaacaccatctctgcaaaaaatacaaaaattagccgggtttggtggcacatgcctgtggtcccatcggtgtggctgaggcatgagaattgcttgaacctggcaggtggaggctgcagtgagccaagataatcacatcactgccctccagcctaagccgcaaagtgagactctgtaaaaaaaaaaaacaaaaaacaaaaaacccaagaaaataatatcatttggcaattccacaattttttaaaatcagtgtctgtgggggattcatatgcaagtgaga

SEQ ID NO: 8293 - DNA, 1239 bp, Homo sapiens
agtgcacccagaggattttgaaggcttatgccaacaattctttggggcagttggagtgtaaccattgctaaatagcagttcagtacttaatgacattcattttagtttaacaaatcattgtgagtgttgccattttttattagggaaaacatctctttcatctttcccaaatactcaacatgagtcctatggtgagagtgaaaaagggttgtattctttttttgcatcatcttaccccatctgctattttgtccctcttctatatatcactgaaatttggttctgatattctattaggcagtgtacattgcagagattatgaataactggccgaattctgaatgcaggcatgatttgttcagctcagagtgttaaatttctgtgttagctgctaacctttaaaagtcaattgatttcctttttttttttcccctctgtataatctagccagcgaatgctcagtagcttttctgtaaatagtgatgatttttcttccccaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtaagtacatgggaattaaagagagtgacatgcttgcacttcactgtgggtactaagtagcttctcctgctaaaatagctcttgggcagtatgggctttatcatatttaccagaggaagccgaaaatgtctttaaaagttttcctatagacagttggattgaagataaatcttagcagctaatttttcagataatcttgcattttctgtgacgtcaataaaaaaattatttaaagcaaatagaaaggacagctggtgggaaaattggcaattaaaaagccagcactgttgataatttaataagtcacctttcttcttagatcttctaataattgagaaagggtcattgagaacaatattatgatttgattttaatgctaactccacatttttatgaccagtaataatgtctagttatgcatgttaagggacatgtaattaaatgtcctccttcagccatgagttgaaataattttaagcataaaatgtttaaagaattctttctctggtccttttcagggtgcacaattaaccagatg

SEQ ID NO: 8294 - DNA, 1201 bp, Homo sapiens
taaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgactatgagtgtgtatttattcatgaaatttgaactgtttgccccgaaatggatatggaatactttataagccatagacactatagtataccagtgaatcttttatgcagcttgttagaagtatcctttatttctaaaaggtgctgtggatattatgtaaaggcgtgtttgcttaaacttaaaaccatatttagaagtagatgcaaaacaaatctgcctttatgacaaaaaaataggataacattatttatttatttccttttatcaaagaaggtaattgatacacaacaggtgacttggttttaggcccaaaggtagcagcagcaacattaataatggaaataattgaatagttagttatgtatgttaatgccagtcaccagcaggctatttcaaggtcagaagtaatgactccatacatattatttatttctataactacatttaaatcattaccaggaactgtttgttttgtagtgaaccttgagt

SEQ ID NO: 8295 - DNA, 1352 bp, Homo sapiens
aagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcaca

SEQ ID NO: 8296 - DNA, 2040 bp, Homo sapiens
gcagttttaatgcagttgtcaacaagtagaacctcagcttgctaactgaagtgttttattagtattttactctagtggtgtaattgtaatgtagaacagttgtgtggtagtgtgaaccgtatgaacctaagtagtttggaagaaaaagtagggttgttgtatactagcttttgtatttgaattaatcatcattccagctttttatatactatgtttcatttatgaagaaattgattttcttttgggagtcacttttgatctgtaattttaaaatacaagtctgaatatttgtagttgattcttaactgtgcataaacctagatataccattatcccttttatacctaagaagggcatgctaataattaccactgtcaaagaggcaaaggtgttgatttttgtatatgaagttaagcctcagcagagtctcatttgttagtttttagtggtaactaagggtaaactcagggtttcctgagctatatgcacactcagacctctttgctttaccagtggtgtttgtgggttgctcagtagtaaaaactggcccttacctgacagagccctggctttgacctgctcagccctgtgtgttaatcctctagtagctagtaactactctggggtggcaggttccagagaatgcagtagaccttttgccactcatctatgttttacttgagacacgtaaatatgatagggaaggaactgaatttctccattcatatttataaccattctagttttatcttccttggctttaagaatgtgccatggaaagtgataagaaatgaacttttaggctaagcaaaaagatgctggagatatttgataatctcatttaaactggtgctttatgtacatgagatgtactaaaataagtaatatagagtttttcttgctaggtaaatccagtaagccaataattttaaagattctttatctgcatcactgctgttttttactataattaaatgaacctcatggaaaggttgaggtatatacctttgtgattttctaatgagttttccatggtgctacaaataatccagactaccaggcctggtagatattaaagctgggtactaagaaatgtcatttgcatcctctcagttactcctgaatattctgatttcatacatacccagggagcatgctgttttgtcaatcaatataaaatatttatgaggtctcccccacccccaggaggttttatgattgctcttctctttataataagagaaacaaattcttgttgtgaatcttaacatgctttttagctgtggctatgatggattttattttttcctaggtcaagctgtgtaaaagtcatttatgttatttaaatgatgcactgtactgctgtttacatggacgttttgtgcgggtgctttgaagtgccttgcatcagggattaggagcaattaaattattttttcacgggaccgtgtaaagcatgtaactaggtattgctttggtatataactgttgtagctttacaagagattgttttatttgaatggggaaaataccgtttaaattatgacagacatccactagagatgggtttgaggattttccaagcgtgtaataatgatgtttttcctaacatgacagatgagtagtaaatgttgatatatcctgtacatgacagtgtgagactttttcattaaataatattgaaagattttaaaattcaaaaaaaaaaaaacaaaaaagtcaaaaggtatccacatgatacttacactcaaaaaaggtggcaaaggaagtaagcagaccacaagatgtctttaaggaaatgactaagaaaccagaaagtagagatcaggaacatttagtgatttttggccatcccctgaccttcctaaacatcataacgtcactgcatgctgggggactgacctgcaaagggagcttgtcaactttgatgatctagagaacacctcattggggctctcctggaaccagcccatgcagaaatgattcagccatttctgagaatgtgtcccctgcagcaaaccagctgtgttgcatccaaaa

SEQ ID NO: 8297 - DNA, 1111 bp, Homo sapiens
gaaatgtatttgagttttgaagttccacctagttcctggaccagcccctcatgtttcacatggcgattctgttgtcctttgtttcagctagaaaataaactttgttcagtcttgccccaaatgagaagttctaggcagccaggtatttggcaagagtataagagtcccaccaaggtttaaagtataaagttgaatttctaagcaagcctaaagagtatgtgcaatacacatcttctgattttatgttgttacatgtcgtgaggggtttggtatcttcaagtaaaggttttaaaggaacctgaactagactcaaacttgaccctctgatgctaatcgaaaatacacaatcatcaaatggcattcttactccattttttaactattacatatcccattttgacaagttattcttaccttttttacataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttgg

SEQ ID NO: 8298 - DNA, 1372 bp, Homo sapiens
caacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttc

SEQ ID NO: 8299 - DNA, 1947 bp, Homo sapiens
accttgcttgtttgttataccttcatatgttcagtttttcctaacatatgtttgtgatgttgtagctaccttgtagatagtgactgcatctttgtttttgcttgccttttagcaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattattt

SEQ ID NO: 8300 - DNA, 1023 bp, Homo sapiens
cctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgagaaattaaaaaaaaaaaaaacttattttcttactaaaagcagtctgattacttagttgcatgcccttcttagtatcatacattatccaaaagttaccctttgtttttttttcagtattttttaaaatttttaagttgtga

SEQ ID NO: 8301 - DNA, 1203 bp, Homo sapiens
aaaaaaaaaaaaaaaaaaagaactactactacataacaaaacctcatgtaatattttcttgtttcagagactgttagacaaaaataagtgggtactgtctgcgagatgttaacagactgtctgcgttagtctgtggctaacattggacacatcctctgtgttaggcattgggctgtacactgaggaaagagcagtgcacaagagaaatacagttcccatccttgtttatagtctagcagaggtgaaaaaacttttttcatggtcgtaactagcatttatacattgtttatatcgcattttccttaaactattaaaaaaaacctttggaagcattttgtgtgagagcttgtttacattagcacatacaaaccatgtaagatggccttttgaccatattaaatgggttggtgtatattttaagcaagaattataatttatgaatataccatttaatattacacgtaggtgggattatcacagaatagcttaaaaaaatcccctaaacactaatcatgtgttatttttggcttcaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggtgagtatgtggctttaaacttttacaaattctcctttggccttgcagataatgcttttgtctagttctcattcattcaacacataccttttgagcccctacgttattccactctctgttctaggcactgggacatagcagtaaacaaaacagcaaaaatacttgttctggagcttatattatagtgagggagatgagacagacaagataaatttataaaatatgtaatacgtgagaaaatggtgagtgctaagaagataaataaagtaggaaagggagataacacatgccagtaagaggaaaatttgagatagatagcatggccagggcagtccttgatgcaccacgcacgtacctgggtgtggcatgtaccaggcagagggagcagccaggatgagggcctgcacctgggagcctgtctgagggtgtgaagaactgcagtgatgacaggggttgcaggagaacgaggagggcaaaggaagtagaggtgag

SEQ ID NO: 8302 - DNA, 2182 bp, Homo sapiens
ataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttg

SEQ ID NO: 8303 - DNA, 1159 bp, Homo sapiens
ttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattggcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttccc

SEQ ID NO: 8304 - DNA, 1207 bp, Homo sapiens
ttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggc

SEQ ID NO: 8305 - DNA, 1299 bp, Homo sapiens
tcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaaaaaaaaaaagaaaaaagaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaa

SEQ ID NO: 8306 - DNA, 1399 bp, Homo sapiens
gtaccactgcactccagcctgggtgacagagcagaccctgcctcaaaaaagatagagatagagagatagagaaatagggggagagagagagagaaatagtagcttttggttactagaaaggattgcccaaaataaaaccttgtgtttagaggaaagagtataaggaataaaactaattctttggtctttttttccctccttttctccttaggttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttc

SEQ ID NO: 8307 - DNA, 1112 bp, Homo sapiens
gctattagacctcttagccaccctgcctcatttgctttcaaggaaatgaccaaagaaaacttggtatgttattttagaatatgaaatcctgtaataataaatgtatgatttaactaagtcagctaaacattgtcatttttgaataagtgtcagctctctttgtgtacctttctgtagttctaaattattgcttcttatttaggatgctgcagctgattcagagtaggctacaagaagagcattcacttcaagatgtgatatttaaaagtgcttttaaaagtacatcaacagctcttccaccaaggtgagatctgtattttaaatgtgcaactgtttattatgaatttactttgacatagttaaaactaaagtgttggtttagttttctgaatcttatttttcttaggaagggaaaatagaatcattctgtactataaagacgccttttgctcttaaatttatagcctgtgattttgatcagaattatcacaaatatttatttgcatttaattttcttttttatgcgtggtatacccccacataaaattatattgagttttaagaaaaattagtttcatttactattttgaggatatataagctttggttagaaattttgttttatttcccgtttttgtattttaattaaagattagaggctgggcgcagtggctcacgtctgtaatcccagcacttttggaggccaaggtgggcggatcatttgaggtcaggagttcgagaccagcctgaccaacatggtgaaactccgtccctacgaaaaatacaaaaaaattagctgggtgtggtgggtgcatgtatgcagtcccagctacttgggaggctgaggcaggagaatagcttgaacccaggaggcggggttacagtgagccaagattgcaccactacactccagcctgggtagcagagcaagactgtgtctcaaaagaaaaaaaaaaaagattcgtggatatttggaaatgctataatcataaacataataaaaatatacaagattttacatttgcttaggaagaaaatgtcactgtctctttgaatttaggtggcatgcctttcctttacctcaatcatgtttctgccctccctccctctcc

SEQ ID NO: 8308 - DNA, 1111 bp, Homo sapiens
ttgttgttgttttcagcaccaatgcaatacttcatttttttccaaatgaagtcttatgtattacatagttcgccacataagcatggtgaggatatgcagaagtttgtctacttggcctactcctggttcctatctcctgagcctaaactcctgggttatttggaacacagtttgaactctagatgactttaagacttcatgaaggtctaaaaatctgtaattcctattttaaatcagatgaaaattattacacagaaaaaagttatcatagaaagcacaggactgaatttgatcatagccagtctattattcgcaatgcttcattctggtattcgaaaattgctttgatctaatcatttgaaaatgaaaggccatgaaaaattttaagcatcaggtgatttacttttggtagtttggttgcatttatcctgagttacatagacctagtttccagtatgccactttaatggtgatgtgatcttaagccaggtatttacactaccgtgaacaccagtggtttacttgaaaatctgtgaagccatccatttatagctccatgatatagaataaaggagataatatttgtagaacatctagcatcatgcttaatatatggtgtttgataaacagagaagaaagacaattcctaattcttgattttgagagttttacattcttaaaagaacattctatcaaaagtttatgtaaatagagattaagaggttaagactttttctgagttgcttagagttattgattatagagttgccattattaaaggatactgtgttcaaaaacctgtgaagtcagaaaggcttttggaataagggcaaaatagaacttgtaatttaaagagcctttgttttggccatgagaaatgcaattcaagttctaatcgacataatttattctgcttgaaatccaagtttttaataggtcagttgatttatatttctcatgttttgctaattaattggtaggtactaatgtttaatattttgtctttcagcaaattaagaattaatatagatattactgttgccatgaagtgtcaatgtaagtacaccttcaacttgctgaatccacatgtaggttatggttcaaacaattg

SEQ ID NO: 8309 - DNA, 1340 bp, Homo sapiens
gttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggattctgaacttttgtgtgtgaaatgttttctgaaatgtggaggtgctttaag

SEQ ID NO: 8310 - DNA, 1113 bp, Homo sapiens
gaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgatactttgttttgcttcattgttgtagaatcttgatagtgtttcataggataagagacttcagaaagcagagagatcaaaccaaaaccattatgtagaaaaaaagagccttctgagtaaggggtgaaaatttgaaccctacctcacaccatacagaaaaatcaattcttggtggcttagcaacctaaatgtgaaagatgaaacataatttttaggagaaaatacaaaatgtacttattaacttgggaaagggaagttttcttaagacatttaaattataaaggataagtgataaatttgactatgttcacaggtgttttgctataaaaaaattgactatataaaaattaagaatttctggtcatcaaaatatatcattaaaaaggagaaggcctgtaatcccagcattttgggaggccaaggcgagtgcatcacttgaggtcaggagttcaagaccagcctggc

SEQ ID NO: 8311 - DNA, 1234 bp, Homo sapiens
taaaaactgggagcaggccaggtacggtggctaacgcctgtaatcctgacactttgggagtctgaggcgggtggttcatctgaggtcagtcgggagttcaagaccagactggccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacct

SEQ ID NO: 8312 - DNA, 1148 bp, Homo sapiens
ggtaggtagcataagggaacattccactaacaggctcgtaggtagatagcataagggaacatttcactaacaggctcgtaggtgggtagcataagggaacatttgaggagtgatgttgggacttctcaaccttgcttctcatatttgggggcttgctagcattttgtgacaggcgccatgctagttatttactcctataacttaccagttttcccagtgaggcgtgtatttttcctattttcagttgaggaaactgaaagctcagaggaagttagacactaggctagggttatagattgcagatggtaatgctgggatttgaatctagggatcgcttggattattttccattttgccaggatgcttcccacttggccaaacaggccagaggcaagttctatggagcccctggcaaagccagcctgctctgatgacgtatttcctgcctaggtggacacagttgatgtcccatagtactttggtttatttctctcccatgagaatgcagccactgtttattattttacagaacccaatgctgggcagatacaagaaggaattggagaagctgtgaacaatattgtgaaacattttcataaacctgaaaaagaggtatttatgggctataaaacttagtatagtgggacttttaaagatgcttttatatgtgatacacgaggcaatatggggtgcttgaattttcatttgtaagctttctggtagctgtaaaaacatgcttcatatagctaccttcagcacttgcttctctagtgttttttttagacatagatgcaggagatttttctttggcactgtgtgttatgccccacagagaggaagcctcaccgtgttgctgtgtggagaaaatggcctggttgcagcccttgagcaagttttccaccatgggttcaaatctgcccgcatctttcacaagaatgtcttcatctgggacttcataggtaaataaagtagatgtgtattacattaaggtcactgaagcctttcttaggaactcaaagacccaggaatctgagtgaataagggttagtgataaggatatatatattttttttctttttttttttttgagacggaatcttactctgttgcccaagctggagtgcagtggtgcggtcttggctcactgt

SEQ ID NO: 8313 - DNA, 1126 bp, Homo sapiens
gcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacactccatagagtctctccttttcagatatcctgggatgaaagaatttggctttttttttttttttttttttgacatctgttttcactcttaggcttttaaacaatagttattgctcttatccctctcagattctaataactgagagtgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtatagcagctttatgattatgagaaaacaaattctttatttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaggcct

SEQ ID NO: 8314 - DNA, 1277 bp, Homo sapiens
tattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcaca

SEQ ID NO: 8315 - DNA, 1177 bp, Homo sapiens
ggagaatggcgtgaacccgggaggcggaatttgcagtgggccgagatcgcgccactgcactccagcctgggcgacagagtgagactccgtctcaaaaaaaaaaaaaaaataaataaataaaaaataaataaaaggaagtgacactggataattaagagacacaccattgcgcctttaacacatattcacacccagcactgtcacatccatcgtgccttgaggacaggcataaatttacggccttcctcctgcgctcccggcctgctcctagcctttgactagagcctgcgcagcatcccagtcccaggctagggcccaccggtgccgcgcagcctcctggaagctgtggggagtagcgttcctccgctccagaactacaactcccagcaggccttgctcctctccacctccctcgcagcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcaggtgagagcagcaggcggcgttcgctcgggccagaccccggccgcaggcctggtcggtgctgcggcagtgcccactcccgcgccagcgcccactcccgcgccagcctttggggcctgtgggaggagggccttgctgggggccccagggctctccgggctctgccgcacccgccctcccggggcagcgttgcatcaaggcggagaatccggggcccggccaggggcggagccggcgcggcgggcctggctagcccggcgggtcccggggacaggagagggaaggatggggccggcgggcggaactggagtccgctgggaccgggcgcggcctcgtccgcgtgccgctgcctccaagggcacctgggggacgcgcggggcactcgggtctcgctgggctcggtgggctggctgttcccatcactgttggctttcgtgagacgggtgttttatttccctccttgccttgcccagggactgcggagttagttttggaatc

SEQ ID NO: 8316 - DNA, 9559 bp, Homo sapiens
aagactccatgaactgtgtccttttgagtttttatggaagcttcattggccattggtgatcagctcaatgtttggcctctctcctctcttctgaggctgttctggtgaccagctcccatcctgaagctatctagggacccccagccaccagtcatctcattagcatgcagagacactctaaacacccttaatgctcttggagagtccaaggattttaggagctgactgccaggaaatgaagacaaagaccaaatatatatttcacagtatcacatttgccaggacaaattatttgataggttttccccattgtaaaaatttgacttgtttagggctttagaatacacaattttacttttaaatccttcctttctaaccttttttaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctgtaagtaagaaatttttctgtagatttggttacctagattgctaggtcacttttccttttgtgaagatgacttcagctcagattatctgattaagatttattttctataaaacaaaaatataactttgtagagataataggatgatgtctggttgtgtgaaaatatgctttgtaaatgatataaagcaaagtaaaattgtcacatatttttaaatattttaatattttataagtatttacttatttttataagtatttaataagtattaaatattttaataagtatttaaaaataatttagcttttaaagtgtttgtttctttagtacacacagtataattgctcacaaaaattagaaaatgcagataagtaaaaataaaacataaaaacaaaattacatgttggtgtgcacctgtagtcccagctactcagaaggctgaggtaggagaattccttgagctcaggagttcaagtccagcctgggcaacatattgaaattccatccttttttttttttaattgaatccaaattttattaaggatttcaagttacatacttcagatttctagaatggaatggaataattttggaactggaaaaatggcataaacactgatatcccttgaaacttcaattttataaagaaaattcttctgcaaaccacatccccattatataacaagaccaggtattatcgacaccttcactttggcaataactatttcctaaaagaatgaaaaagattattttgctacctcagttcgttaaaaatgggattctggccaggcacagtggctcatgcctgtaatcccagcactttgggaggctgaggcgggtgaatcacctgacatcagttcaagaccagcctggctaacatggtgaaaccccatctctactaaaaatacaaaaactagccgggcgtggtggtgggcagctgtaatcccagctacttgggaggctgaggcaggagaattgcttgaacccgtgaggcggaggttgtggtgagccgagatggtgccactgcactccagcctgggcaacagagcaagactctgtctcaaaaaaaaaaaaaaaaaaaaacagggattctatctttaaagttcagaaaaagctgcatttagatgaactacggctaccaaaacaaacaaaaaaacagagtgtctaatcaaagcaaaggaaatgattttgaaaatagaacaaagctattataattggttaaggatttccagtagtaagttaaaatctcaggagaggaatggatagcattacaaacaatgtgttcacattccaagacctgaacactaacttctcaaaaaggaagttttcatcacctctaaaaatgaattcaatgtaattttgttaagagcaggaaatctagaccttcctctaatgacaatccaatagtccaccctcgccatcgtcaaaagaaagttgcctcaaaattaacagtaattagcctgaggtattgtaaatgtggcactacagtctgaaatttaatggcatcttttgtcaaaaatagtcttatctctactttaatctcatgactacaatactatgtgctatccctgtagtatttactactatgcagtcatacagaaaaaaattgttggaccttgtgaaatagtgcatccatctacttctataaaaataggagccacattggccaggcgcagtggctcacgcctgtaatcccagcactttgggaggctgaggcaggcagattacgaggtcgagagatcaagaccatcctggccaatatggtgaaaccccatctctactaaaaatacaaaaattagctgggcgtggtggcacgtgcctgtaatcccagctacttaggaggctgaggcaggagaatcgcttgaacccaggtggtggaggttgcagtgagctgagatcgcaccactgcactccagcctgggcaacagagagagactctatctccaaaaaaaaaaaaaaaaaatatatatatatatatatatatatataaattatattaattaaatataaattaaatatttaatatatatataaaaaataataatatatataataatatatatagaagccacacaaagatcactaactgatagtttagtttgataactgttttccagtttagttgtcaaagcatggtgtgaacaaaatgctgagtgtcaacactggcattacaaataggcccaaaatgtgagcttttaatgagaatgagaaacattttatgagatttaactgaatatgccttaacacatccatgaggtagttaagtaaacagtactacacattttaatacatagtaaacagaagcatgggtaagtgacatactcatacttcaagcaataagaattagaagaaaccacacagaagcttggggcattctctctagctctaccccaaagaaaatgaactttaatttttttttttaaagcatcgtatcactgaagattttcttcttcttcttctttttttttacacttgcttattagtatagtatctctttccaaagctggtacccttttcaataatgtggtaaaaactgagtataacccttaattcaagctaggcctctccttctacctgaattggtacaaaattaagacatcttgtaagaactaaaattgtatttgaaatttttattttaggctacaaaaacaagcaaacaaacaacaaataacttgaaaacaggtcttgtcaaatgatgtaagttcatcctttccagggaagcagaaggtagaccctaccacaaagaaaagatgcttagttaatggaggttaaatttaaaagtacagtgaaattcaggctaacttctgaaaaatcctgttttattcacctcactgtggtaccagtaactatactgagtcaggttactttacagttaactatgtcacctataacacaataatccattaacaatctaatacagttattgggtgtggtcatactggaagttcttaaattcttaaccatatagttgtcttgccaatttttttttctttcagatgagtcttgctcagccacccaggttggagtgcagtggcacgatctcagctcactgcaaccaccgtctcccgggttcaagtgattctcccatctcagcctcctgagtagctgggattacaggcacccgccatcatgcctggctaatttttgtgttttagtagagacggggtttcaccatgttggtcaggctggtgttgaactcctgacctcaggtgatctgcctgcctcagcctcccaaagtgctaggattgcaggcgtgagccaccgcgactggcatgccggttttttttttttttttaaacgatggattgtcttagtacaagtccctgcatttctgtaacaaagtaatgaaaggcacagctaatccaagcagacttaaccctattcaacaaacagctgaaaaaatactttggttcttcaaggaaaaaattacgaaaaaaaaaagtgtttcctttaacagttgttaattttcatagctgtactccaagagctatataaatattccagaagaaccaaattatgtagcagcgaatgaacatgtgtgacagaatttgtgcattcaacatacctggcagaaaaactagtgaaaatgctaggtagaacagattggtctttaaaatatcagtttcctgtcctttaaaacaaaaattacccagtctaccaagaaaatacaaaaacataaggcagtaagtaagaattgtgtttaggctaggacagtgcaggttatcctcaaggccacatatatcctgcttcactgctgcttgcactctgctgggttttgatccttcttcgggtcatagtctggatcattttcctcatctcctttgtcctcttcctcatctgcttcttcaccttcttcatcatactcatcatcatcatcttcagtagcttctccagtaaactataacactgatcttgggattgtatgctcacgtaaaaagtgaccaattttgaagtctgcagcaaggatagcttcagcatcatcatccagatctccactctcaggaacttcaggaggggcaagaaaattaaagaaagagtcattggaaactgttttagtcacaatacgaattgtcccatgtccctagtgtttctgctgctgcttaatggttttcaaaatgacattctttccttttttccaatctatctggccccctgtacaacccataatttcttgtccatcaaaggaaaagtgatcagaatcatctggttctggttctaacctcatcctatatgtctttgtcagcacttcatttgtaaaatatttactgggttcaaattgaaattctaagacaaaactcataggcaggccagcatctgagaacttcactttggtatctttcacatgcttcagaataggttcatcatgtttctgaagcatatcactgagcaagtcaacattcttaaaaacaggtaaccaaaattcaggaattcctttggggtcttctttttcttcatcgtttttctcatcttcagtcttggccttttctttcaactcctctgaaatctcatcttcttcatctggtttccattcacattcttcctctgtaggttcataaattgtattagtaatctcagattgcttatcaaatagaggctgatagagaacagcatacttcctttcaagatcgtgaacttcctcatagaatttggcttctatctgtgcacctttaacttgcaggtttttgagagcattcactcctcttttaactaccctagctaggcaggttgtcaatgtctgccatgttgtaagaactccaaatatcagtggctactatgagaagccaggcggctggagctgtgcaggcagtgactcagggcagcagtggtggtggggaggagcaagaggcagcactgcaagcagatggcgctaaaaaaagagaccctatctctgaaaatggaaaaaaaaaccactcttaatttcaccaacctgagataattcctaaaatttggcattgacctaggcatttttgtatgcatctacaacacatagatgcctatactacatgtctttaaaaatcagatgctatacctatcttggaatcatttctcaaatcatgtaacaaataactttctgtctcatacattatcagtctgaagatttgcatagtattttactttttagatataccctcatttgttaggccagtctcctactactggatagtttgttttctgttatatacacatataagctgtgatggactacctgcatctgtctttggggctttgtgtccaagtaaacactgaggataaatttgtagaagtaagtttattagattaaaggatataacatccttagaatctttcattacatattgcatattgttagcatattgtactgttttactaccagcaagaacatccatttctctacaccctcattagaacacctttttattttgaaataattatagactcacaggaagttgcagggtgatgtacagggaggtcccatgcaccctccactgtgtaccctttcccccatctcccccactgttggacatcttgcataactatagtacaataacaaagtgagaaaattggacatgggtacaatccacagagcttgttcagatttatacgtgaatttgtgtgtgtgtgtatgtgtagttctgtatactttagtgtgcccaagatggtcttcatatgagtcaactccgtaaagagagtatttatcagactaattattggttatatgtacggcatattgagaaaaatagattaccacaaatgggcctttgaagagtttagtgggtaaagtaggtcaaggtaatactgggcttgattaggctgcaaaagtataacttttatttaaatacttcttattgttagatataattcatattcagaaaagtacatacagtgtatatgcacactttataaacagttaataaaccaattatctgtgtccacctaatcaagcgtttcagacactgaagagagaccatttacatttatttcagggtttgggagaactccacatttaagaaggcatttgaattgggctctgaatagaatttgagaaggcagtaatgagagggcattttaggcttggcaacagcaaagaataatgcaagaataatgtttttggagaacagcaagtatagtgatgggacataataggagataaggcaggaagggtgtctaggaacaagactgtagatacgaagttttttctgtcttgctctgtcgcccaggctggagtgcagttgcgcgatctcggctcactgcaacctctgcctcccaagttcaagtgattctcctgcctcagcctcccgagtagctgggactacaggcgtgtgccaccacgcccggctaattattttttattttttatttttattagagatgaggtttcactgtgttagccaggatggtctcgatctcatgaacacgtgatccacctgccctggcttcccaaagtgctgggattacaggcatgagccactgtgcccagtccccctttttttgagacagtctcactctattgcccaaactggagtgtagtggcgtgatctcggctcactgcaaactccacctcctgggttcaagtgattctcccgcttcagcctcccgagtagctgggattacaggcgcgcactactatgcccggctaattttttgtatttttagtagagatggagtttcaccatgctggccaggctggtctcaaactcccgaccttgtgatccgcctgcctcggcctcccaaagtgctgggattacaggcatgagccaccgcgcccagccgaaattcttatctattaagcaattactcattcccctctcctccctccagccctggtaacctctaatttaattaattaattactttattactttgagacagagcctcactttattgccgaggctggaatgcagtggcacagtttgggccagtctctgcctcccaggttcaagcaatcatcctgcctcagcctcctgagtagctgggactacaggtgcccaccaccacacctggctaatttttgtatttgtttgcatttttagtagagactgggtttcaccatgttggccaggctagtcttgaactcctgacctcaggtgatctgcccacctcagccttccaaagtgttgggattacaggtgtgagccactgtgcctggccgaatttactttctgtctctgaatttgcctattgtagatatttcatataaattgaatcattcagtatttgtccttttgtgcttggcttacttctgttagcataatattagactagtactttttgcctgagctagtataaaaaagtactcaatagtgattgtaaaaatagagaggaagggatgatttggggaggcattataaaggtatttgtagaattcagatggacttgaatttaaaaaaagataataccagggtttctagttattaaacaagataggaaacataaggtgctcagtaactatatcaagagatttaatttgtctaaggctgggcgtggtggctcatgcctgtaatctcagcactttgggaggccgaggtgggcagatcacgaggtcaagagatcaagaccatcctggccaacgtggtgaaaccccgtctctactaaaaatacaaaaattaggtgggcatggtggcacatgcctgtagtcccagctacttgggaggctgaggcaggagaatcgcttgaacccaggaggcggaggttgcagtaagccaagagcgcaccactgcactccagcctgggcgacacagcgagactccgtctcaaaaagaaacaaaacaacaaaaaaagagagatttaatttgtctaaagcaagagtagggctgggcacgggtggctcacgcctgtgatcccagcactttgggaggtcaaggcgggcggatcacttgaggtcaggagtttgagacaagcctggctaacaagctatacttatttatttacatattgtctatggctgcttatgtgcttaatggtagagttgagtagttgcagcagagactgtatggcctgaaaagcctaaaatactatgtgaccctttatggaaaaagtttgccaacctctacttcagattgtgaatcaatggaaataaatataaggcactgtttcctgtcctcaaggaaaactagggcagagaaaaggtgcttagcaattcttagttaactgttgatttatgtcagaacatttattatatttacatatatataatttaatgattccttttcccctttaaaaaaattagagaaactagttcataatgagctgagttagaacacatggtaatgggaatgaatgaaattgtttatctgaggctttctcagaaaataagatgagcttaaagcttctagaaagacttctaacttgtatcttctttccctttttgcaatgccagaaaccatatacttcattgcctttcagatgcggtggtgctagaatttgttatattttccatgagacttttgggcgaaccttagaatctgttgatccacttggtggccttaacactattgacattttgactgccattagaaatgctactgtgagtatgtttagctttttagactgtaaaaaaaaatgaggttaaagtttttcttacccatatactgtgtctttttaaatttaattatacagtttattttgctctcatatttgaaattaaaaagcatttttcatgaaaagtaccaaaaatgtgactttcttaacccttgggaagaactgaaattacatatataataagagttctaagttttattttctcagggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggtaacggagagaaatgtaacaggtttcacatgaactagaaaaggacatgaagtggtggtttcactgggtggaaggaaatgtataagat

SEQ ID NO: 8317 - DNA, 1264 bp, Homo sapiens
ttattttcctcttaggattttgaactacatataatattttaactaggtgctttatagttaaggctaatcagtcactacctcaggtccttagatgtatcctttacccaaataagttaacatctttaacttatgccttgttacgaacttattttcttattgttgaaaatgaactaaaaaagtgacagggaatagtggatgatctgaagttttaatagcaaagttgcataaagtgttggaatttagatttgcattaggtagatgactatttttccctaagagtaaaatacttgtagttactttaatgttatttttccctcttagaaatgcagttttagatgctgaaatgtaaataattttaaagctagagtaaattattgtttggcataagatttatcagttggaatataattatcaagtaatttaggcataagtttcctgtactttttcggtattgtctgtttcataagttttatatataaatttctcaaagtaaaatatggttgatgtatttttgtatatcgcctaacttactttttttctaggtccataacttagtggcaattgaactggcttatatcaacacaaaacatccagactttgctgatgcttgtgggctaatgaacaataatatagaggtaaatataattcttaaatgctttttcacaggtagaaaaatctgttgtaactcagttatatcaaacttatttagcatggagtaactataaaatagacatgtgccacattagtgcctgctgcatgtcaggaaatatgctgaggggattacattgttttcttaattctcaaaaccacctgcaggcattattactttctgcttatgaaattgaaattcagaaagaatctgaaaattcattgatttggtgtgactggctctattttggtaacttatagtttatacaggggaagtgtgtacaacaaagtatttaaaattcttttcatttggctttgaaagctgtgaaggaaacactcaagaattaaccaacttagcataaatttggaaaagcagagtgcttttttcaccactactggggtggctgcatttcatggatcttttctttccttttgattttaatgtaacaaattgaataagatctcagatggagccaaggctggtggacagagcaatttatccagaagccattttttttctctgccgcttttctccaaaaatagtacatttttctgctactccctaattcagtaagacctgagtcccctgctataccaaatttcctcttctgcatat

SEQ ID NO: 8318 - DNA, 1388 bp, Homo sapiens
gccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagagtacgaaaaattttacgacttttttcctaccagattctgacagttcaccaaggtattataacatctccatttttgcgtatgaagacagtgacttgctccaagtaatccaggtagtaaatggctagaatttgaacactaaagccatgctctgctgcctgtaaggttttcaaaagaaatctgattaatcatttcgtatgtgattcacttgatcctcaaggcaacagggatgccattgccttgatttttcagatatggaaatagttctggagaattaatttgcctcatgtttgaagagctgaactcagtcttgattccaaatcctttaagtttgacctgaaaactttccttacctggatactttttgatattctcatatgattgcatatttggtataattggctttatttt

SEQ ID NO: 8319 - DNA, 1345 bp, Homo sapiens
tccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcac

SEQ ID NO: 8320 - DNA, 1946 bp, Homo sapiens
tatatatttgctggttggagtatagctgactcattgaaatcaaagccaattttttggaatttaatgtttttcatatgcttgttcattgttatagttcctcagaaactgctggaatttcgttacttcattttaccttatgtcatttataggcttaacataactctgcctcccacatccagacttgtttgtgaactgagttgctatgcaattgttaatttcataactttttacatctttctgaacaagacttttcagtggccaaatagtcaggacattcaaaggtttatgtggtaatatcagtgatattttgaactgtaaaaatggacttaataattagaccatttctacaaagaacaactgaataggtggaaaacatggaatttcttttaggtgcagtggtggtcctcaaattacattagtttttttaatatatattttaaacatatgtaagaaattaagtggcaaagaactgggaaagcttaagacctgcttcaaaagcctgaataatgggaaaataaaattgttttcagatatctcatatcgctctcgtaatgttggcccctcacaaagcttgggaatgttttgtatgtataagtttattaaaactgggtatgcttcatattactagaactaatttattctcttcagagagaactattaggttagtgcaaaagtaattgtggtttttgccattgaaagtaatggcaaaaccacaattacttttgtaccaacctaataacaatgtgttagcaaatatttacaaatggtcaggtgatattcttgactgaaaagttccttaacatttcagtaaatataattttaattctaagtcaaaatagaaatgcatagatagtaaatgataaagtagagactcatatatgtctgtctaggcatcaaattgttggttattgtttacaatccagaaatgatgaagctctttcactaattcctaatatgaaatgtatgatggccaaagacaaattgtgttgattataatcctttaaaagggggatttcctttatgaaatacatattgtattagcttcccagggctgccataacaaatgaccacaaacttgggtgcttacaacaattttcctcacagtctggaggccagaagtctaaaatcaaagtgtcagcagagttggttccttctggaggctctaaggaagaatccattctatgtctgtttcctaatatcttgtggctgtctgcaattcttggagttctttggcttatgggcatatcttgtctaagtattgcagacagcaatcttcactccagtctctgcctctgcgttcacacggcctttccctctgtcttttcattaccttttaaggacagtgtctttgaatgtagggcccaccctgatctagggtgattgtgtctggagacccttaattatgtttacaaagacccatgttccaagtaagtttgtattcacatgttctgagtagacattgtctcttcatgggatacttttcagtccatgacagttactaaaggacattttaggataatcctcatatgattgttaggagactacctttaaaaattttttattatatatcaaattatagttgtatatacttatgaggtacgaagtggcattatgatttttgaatataatgtgggatgattaaataaagctaatctatccatcacctcaaatatttgacatattttgtgatgaaaacatttgaaatgtactctcaacagtattgaaatgtacatacagtgcttaattattagctgtattcaccatgttgtgtaatagatctaaaaaaagtcaaacatattccttctatctaattgaggctttgtatcttttgattgtcatctccctattcccacatccccggcctctagcaaccatcattcttctctctacttctgtgagtttaattgttttagattacacaaataagtgagatcatgtggtatttg

SEQ ID NO: 8321 - DNA, 1290 bp, Homo sapiens
ccatttgctggtgaattttccaaaatagataacagataaaatgattatgtaagaacttggcacaacagatcattttgcctttagtcgttcaagaaatgatactaaactcaaagtcattcacttgaaacaactgagaagaccattcttaggtgtttagatccttgcttttagaaacattcttagttatatttgtgttttcaaaagttattgagtagatagatattttttcatgaatttttaaacattagacttagctgaattgattaaaattaggtgattatgaaaaaaatattgccctgctcgagggcatctggagccctacagttaccattactaaagtctgtgagtatgtctattttgaaaagtgtcataaaaatatctagtccataaatcattataggttcagtaatacatcattttgaactgattctatcttctgtgaaattctagagatatgttatctttaggtagcatgagtaagattcaggtatgctgtgaattttgttaacgtttatgttttccattaatggatagtcaggaatcttttgaactgcgtctatgtatttaaatgatttggaaagatagcatctctcagtttaaacttagcatctcattttggcaagataaattattttagctgtctggccttttctttgtcttcttagagttatttctgaaatgtgcatagccagtcataaaataacttgtgtaaatagcctaatgtaatttatttctaataaatacgtagcttaatgaaatgtatttctagtttgaacttaattgccacttggcttgatattattttccttagaattgttggaagagaggagagaggaagggatctaccatttttatttataccacctaaatagtggactgttattttggactcacttttaaataaaatatttattcacatgaagaaataaattttgtgtttattaggttagcaagcgtttattatctttgaagtaattggaatttcattaaaaagtgaagcaagtaagaattgtgatataaatttgaaaatttttaaatggaaattgaaatatgacttaggaactgtgggcttgtagaaaaaaacatttaacatgggagttaagatttttatatttggttgtggctctgggatcaataaggcaagtggtttagtctttagtcctcatttcaaatgagaatagtatttgtcctaactctagtcagtgtctgattggtatgtgtataaccttattttaaaaaggattcattcctgccatatactcataatatttataagtatgtcatatgata

SEQ ID NO: 8322 - DNA, 1097 bp, Homo sapiens
gtggagatattgtgctacatttccaagtgttgtagttaaacttttattagtctgaattaaactcttttatagtgttttattgttttaaaccacaaagatttataatcatttatatctatttatctaatgttattcaaatgttttctgcgttgtatgaagctaagataaatgtaaaaaaaacaaacaaaaaaaacctcactttgtgttttgtaatcattagacgatttaacctaatatatcttcccatatgatatgatctttgcatatggcatacttcattcatatgacatagttagaatcttttcccacaaacaatgagtgatgatatctcatttgaaaactcgtgtaacattgtatcagccactgttataaagtgatttacccatgttagtctcataacaactctatgagatcagtaccgtacacatggggaaacttagtatagagaggtgaagtattttttccaagattacaaaataactgtctgagctgggattcgtaaccaggcagcctgactccaaaatcaatattcttaactctattgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatgaatttaaggaagtaaaaaaataactcagggctggagccttcagccatattaacatacattgacataaagacctttgttttaatatgaatgattccagttaacaaatggagaaatagttgtttgaaaattaatatttagcttctcaaaagagactcctgtttggaagcaaattgttggtttaacaggacatactttagatatttgaaaaattctctgtggaatcacaatctcttatttttaagaatgtaggaatatgtgttctatatgcttttaagttatgtattacatactattctctaaaatagaaatgtttatttggcttctaaaagtc

SEQ ID NO: 8323 - DNA, 2116 bp, Homo sapiens
ttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttacccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttcgttgttttctgtacagagcgttcagtttactcaggctgaatgttttctgacatatatctccagtatgaatttgtttatgtaaggaagagtttttcaggaagagaaagtagagaagaaaagaatgatgtaactaaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatat

SEQ ID NO: 8324 - DNA, 1220 bp, Homo sapiens
atttaggtcaactgcctccagagccctgaggctttcgctccccctctctcggcggtcgagacccacagggctcccattcacctgcgcgtcggcctgcgctagctatagccctcaggcgcgccgcgttccgcgcactcacaccaccctctgcgcgccagccctgcgtccctcccacgcgaactgcgccggcgcgtccagccctcccgcccgggggaggggcggggttgcgtcgctgccgctgacccttgagcgcgcggcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtacgggcagttcccggtgtgggggacgcggcgggcgcggggcgctgggcgcgggctcggcctagcccgggctgctcgccggtgggtgccgcgtctcccgcgtctttcctcctgtctctgacccctcactcatttccctccttcccctccggccggggctaaacctgcgctgctcccgcctgagagtgtcctacactttctgtgtttatcttttgacccagtcatgcgccctttaaagcagttagaaattaattttcaactttttaaaaagagggttctttgaaaataagaggtgtccacaaaagccttactgctgcctggctagtgagaatttcctcttgtttcagtggagttcaagttgagatatttaaacatgaggctggcgccctagttcagtgtttaaggattgtgtgtgtgtgtgtgagtgtatatgtgtgtgtattttgtccctcatgctgattttcctgtgttaacgcttacacttctaagtattagccatggttagttaaa

SEQ ID NO: 8325 - DNA, 1132 bp, Homo sapiens
caacacctctcacttccatttggactttttctcctcagtatttcgtaaactgatcacttaaggaatagtcaagggacaataattttttatctgtatcttaatataatgtgaaataatattttggaatcgaataggcctagaggctttgtcttacctaaaatttaaaaagtaacagcctcacttgcttcggcagcacatgcactaaaaattggaatgaaacagaagattagcgtggcccctgcacaaggatggcacgcaaattcatgaagtgttccatattaaaaaaaaaaaagtagcagtcatttcttctttaatccatttcacatatgctcattatgcatagtgaaatggagagagttttcttttcttaaaacatgttaaatctagcacttaatataatttgccagttagtgcctatacacaaccatctgaactgctctatgttttttaagaaaataattaaagatttctaattccttttcaaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtgagagtctagttgtcttcatgtacataatttttgtttgtgttgctttgcacatgtaaacatttattgaataaatatgcttcatttctttttccacctgtaactctaaaactacaacttaaaaaattataaaaattgtttgagttgacttcacagtcagtttgatcagtatggtcccccacctggattgtttatttttaaataaaaaacagacttcttttttacagaatattaatattctagttagtatgaagcaattaaaaattattaaagttaatagggatgggatggaagaaatgttcaatgtagcaaaatgttagcaaatgttatttttgaatattgggattacagatgtttcttatgttttttcattatactttaaggtagtttccaaatattaaaggaaaaataaaggatactatttaagtctagttttttagtgaagtcattctgaaaagcaggactttgtttttaatgtgcaactattatggggttattttcatttt

SEQ ID NO: 8326 - DNA, 1301 bp, Homo sapiens
aaatatgtattgtgccattccgcaaatttaaaagctaattgaggacaatttttttttaatttcctaaatgagaccaccttggatttttatttttgccatttagatgtttatacttatttagcttttataaaacataagccaagctaaatcccacataacaactctggtattcttccctcatatgagcagtgattttatttgttacccaccttagatagactaagaaagttctagtcttgtttctccttctccccgcttccctggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaagtagattgtcttttctcttattttaacagggttaacgtattttgctaaaatgtgagctttattactctgtactgcaagattacttcttagtcttcagttcacctactcagcagcaggatagaggaagtgtgagaattgaaaaactacagcagtgccccctcatctgtggttttgcttcccatgtataagtaaaccatggctaccattgtccaaaaatattagatggaaaatttcagaacaactcgtaagttttcaactgtgtgccgttctgaatgaaatcttgcagcaccgtgctttgtcccacgtgaatcatccatttctctagtgtatccacactgtatacactacccacctgttagtcatctgtaccatttactcctgacatccagccattgactatgtcatggttccatgatccaggatcacccaaagcagatgatcctccttctgatgtatcgtcagaaggtcatagtagtgctcatgcctgtaatc

SEQ ID NO: 8327 - DNA, 1140 bp, Homo sapiens
tacttccatctcttaatctctgctatatcaacttgtttatttccttcatatctccaagcagagtcagttattttaaaagtacttatatttagtttttattgtggaatataagcttcctaaaaagggacattttctgttttatcttctgcatctagcacgtgcctggcatatagtaggtgccagaacagtgattcttacgtttatatgtgttcatgccatgagctccccgccttttttaattgggggagaaatgaaaagtttttattttagtcaaagttttacataattagttagaatgtttacataactcaaaaattaaataatgttgcaggttttgttatgaaaaccagctgcatcaccttttctgttcgctgttccccagaggccaggatttttaactgtagctgattcttttagtaattacctctatatctctggttaacataattaaattataatttatctatttttcagttttaggcattatctattgatgcagaagtatttagctctttttcacctactccagcccccttcccttctctcacaaactttcccaaccccattccctcaattgtaattgtgttataattttggtaagatcagtatgcagtgtttactttattataactatgtaatactttccacagatgagctatataatatagtttgattacttttcctctggagactgtacagcagatactgatattattagtttttcatatagttatgaataattcaacctcacacttttacccaattgtaaatctcctctcagtgtaatcagccatgcatggaatcctgtcaaattcatcctttgggggagattcctcccacagccttctgatctcctccacgctgcccaggttggtctttagacctcagccgagtgagggattccttttcaccaccatcctgagaacttgtattggagccctacatttatgtcttattttttgttggtttactattttattttgatggagcatatttctcagtgtcttatgtagaaagggttaaaggcaggtaatttttttttaaacttgcgggtctgacaatgcttgtatttttctctggctttcagttgacagcttgactaagtatataattcaaaggtggaaattatctgctctcaga

SEQ ID NO: 8328 - DNA, 1240 bp, Homo sapiens
ccctattcctcaagcattctagattgattgtattaggtaccttttcccagcatccatgccatggctctactccatgagcacagatggaggattggctgtttccaaggcgactcagtgtgtgtatgtgtacagacattcactctggctaattggtgctattggttcttatccaataatggctttttcttatcacttaacctaggaaaactgcttattagatttgtgacattgattaaactatgggcaatccctttttccatattaggatttgttatacttccaagatggcagttatacatccacatacatagacatctatgtttatatgtgtgcttgtgcaagcattaaatgtgtgtcttattccctcaaacacccagtgtgtatctcacaacctactgtctacaaaaagagaataaccaccaggatgagagtgggcatcaagcaggaatttggtataaaatcattcattttaaagctgctggttcaataaataagctgaattgacattgttgtatcatgccagagcatctgttattgaagaccaattttaatttatttttatataaatggaaaactgtgtgcagaacagcatgggaaatgaaacacactgcatttatttgtgctcttgcagcatgtctctcagagcagctcaattcaggaagaaaagtatcttgtcagaagacaatagaattatcttccttgttggaattttttgtagcttctgatgcacatctgccagtgattctataaaaagatatagttgagttaaatgataatagcaaaatttaatctattgaaatctgagggaaaaaaggtaaaatattcgtgtggctccccagtactgacaggcagaaacacactcatatgtatatgtacatttttcacatcagaggaaatgacaaagctggttctagtgagggaaattttgtaatagaaaagccccctaattgttttttcttgctttgcctgagatttggtttgtggtctcactatgcctaaaccatatgttcagatgaatactattaaaaatcatgttaagccaaaaacatgtctacttttctgcttcatcaatgacaatcatttagctgttttattcacatagaatttggtttaaagtaaaaatcctttctccttccttccaaccagttttacacactggagagtttaaagcccaaattaaagaattttagagaaaattcatataattcagaatagctttacctcctaatagatgtctctc

SEQ ID NO: 8329 - DNA, 1125 bp, Homo sapiens
cttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtc

SEQ ID NO: 8330 - DNA, 1181 bp, Homo sapiens
aagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattt

SEQ ID NO: 8331 - DNA, 1236 bp, Homo sapiens
gcgttattaagaagaagcttacgaaaacagatggtttgacttttcaaaagtcataaagttgttgataaagcaactttatcgagaaacacaagcgtgatgtaggcctcagaattttccttaaaggagatttatgggaattgtgggaattatttccatggagtgccttgctctctatgttttttgaagtgtgaattatgcaagtatttctgaaattaatatgaagattttaaatgataacctggaaatttaatagcaataacctcagtttgcttttttaagatttttcttctgtataaatgaaagccagtgtggagtaactcttaagtactcttcacttctttattatctgtataattattatgaaaaagagtctatattattaatttgtaggaacacaaattttctttaaatctaaaaacaatgtatttcaaaagaaattatcatgactatcatttactataaaataatttttagtacacaagatatattaagatgtagttttgttgtttttccaagcctattattaaataattaattgaaagaatttattgcattttattgaatgtactatttatttatttgttttttagctttaggatccttttccactgtatttggagaagaatggaaagagaagactgatagagacttcgttaaggtaaatcattttaattaaaatgttgattcattgagttacatgcagctaagccaacaatagatcagtggttgcttatttaatatacataatactacctatacttttatctttacctaatacatatgccatacacaacgattttaaagttgtgattgagttgagtgaaaaatcttttagaatacccacgaacagacataaaattttcattgatttctgtgaatagtaacaacaatagcagtaaacaattgaatgaccctcttctcaactgggattctgagaatgggtttcaggaagttttcgtttttatgtgtgttctgaaactatgcaattcagaaaggaatgaagggccagacctgccatcaaatcctcaaaaagaataggtgtaaaagattagtaagtgtccatctagaggaaaatttctgggaatatatttctgaaacaaaatatagttgtgaatttcaagtgagaaactacaaaaagacttgaacaaattgttttctcacttaacacttgtctaactttgctggctttcaaggaaatataggatgcttcttttatttactctccaagggtacatt

SEQ ID NO: 8332 - DNA, 2391 bp, Homo sapiens
aagattgcgccattacactccagcctggcaatagagtgagactccttctcaaaaaaaaaaaaaaaaaaaaaaaaaggtactatgcagaaaaggcaaacagtaatagtcagcctcagtttatccttctagttgtttcccagatgcttccctctcttcctgcaatactatattaacatttacggggtgtggagctatgtattgtttctattttagtttttaaacttgcaaaattcatgataaagagtcatcgctgtgaccttggagactgacaatcttctatatgtttttttgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggag

SEQ ID NO: 8333 - DNA, 1098 bp, Homo sapiens
tgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgct

SEQ ID NO: 8334 - DNA, 1113 bp, Homo sapiens
atgaaacatgaaaataagtctggttatctctttggggttgtttttcacaaagctttctattttggctttaatccctttaagcatgaaaaaagtttaccccccaccccttttttcttaggtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgag

SEQ ID NO: 8335 - DNA, 1031 bp, Homo sapiens
gccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtat

SEQ ID NO: 8336 - DNA, 1602 bp, Homo sapiens
catagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctcc

SEQ ID NO: 8337 - DNA, 1180 bp, Homo sapiens
gggaaagggctggaatgattatcccagcaggcatgtgttcactcagttcccaattttcattagagtatgcctcttgcccacaaattgtgcctagtctctcacctagaaacatatattgtatactttccagagaacatatattcagattgttgccaggataggggaggaccaaccagtcagctttatggagtaggacctggtctggggaatctagctatttcttgaaaaaagttcaacagatcctcactattttagctcaccccttccattatccccaactttcagtcatgccagcagtgccttttagagattctctgaggtaaactgagttggtcttggctttttccactgccgatttatggttcaggtctgtctgctttccagctttcaaaatttcattattgtctactattatattttatcctagcagctttacgccttaaaaaaaatctttttactgggatatcaagggagagggagtaagtccttgtattcaatctactattcctagaattcaattgatttttaactatactggctgagggataattgacctcctatctcatgacactttagtgtctgattaaagcggggaagtggaaaaatttacttttgtagttgaaggaagatttttcctggatgaaactattatagatcatttagttatttgtaagattcatggataacaagcgcaacacaccaagtcttcagctaaatctcatgaaggtagttgtacaaaggctcaaactttaagtttctcactaaacttaggactctcctacctcaggacaaggattcactctgtgactcttgtaaaaccagctgctcctacaactgctcaaagccaagaagcagttggcaggatcaagatatttcatctggtacagggctccattccagactcacattggccaacacaggaaaggagtccaagactgtccaggcttctttggaccagcagctgggaaggctccttagtgtctccctgaggctgggtgtggagccttctctgcagtcatctggaaacttgttggtgcgatttctttttcttggatgagtttgcagctcatttttttttaacctatccataatggctgtcatccctgtttaacacactctaattcagttagattcagtgagtcctgtcctgttgtaagaatggtgctggattttgcatttt

SEQ ID NO: 8338 - DNA, 2773 bp, Homo sapiens
ctgcagataacatactgatcacttaggagtttatatttagcaagttaaatattctttctatagattatatagtggatagattttagtaattaaagcacatttcaaaaaatagaagaaatgtttagcatatatgttttattacttgctgatcaattttctctatgctctttgcaggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgta

SEQ ID NO: 8339 - DNA, 1145 bp, Homo sapiens
tgtgtttgttttcatggtattcctatgaaatgagtcctgttagaagatgtgtatatttttcagaggatatttgtgactgttttgaccttgtttctgttttctttagattgtggtatctgaacgggaactatttggttctgttggtgtcattggtggtcattcttcctttgtcgctgtttagaaatttaggtgagcaaactcatctctaaagagaattgaaatgagcctctcaccagttagttgggctttctctgaatagaaattaatcagaatgaaaaagccctagaaagtagaaaggtatatctttgggacttacagcatgcaaaatttaggagccaaaatatttaattgacactatatgttgtgctttgtaagaaataatgcaaatgatagtttttattagcttgggttatgacaagtatatttaaataaatctataatttagtatcataagaattagaaatttagtgctatacacatactttagtgcctaaagtcttcccagcagaattgagttattcagtgggaaaaagatatttgccttaaatctgtttcattaaactaatactgattcctgccacccctccttataggatatttgggatataccagtggcctttccttgttgtgtatggtgttctttctgattgtggtgggtatgattttttttttagaaaaaattttttataagccctgccatgtcacttagtttaacacatgcaaaataatatatttttaggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacaggtaactaaatatgcttattttctcaaaagaagagtttagggaagaaaagagggaagctattcactcccagggtaaagggaggaggataataggtgctttatagaaaacatgtgattagctaattattgaggactgtgaagaaagttttggtttacatctgaaaatagattgagaattgagataatcatatggtgctaataattgacacattcagaagtgaggatattgatcatacttc

SEQ ID NO: 8340 - DNA, 1116 bp, Homo sapiens
cagggtaggtataaattttgttttggcaaatcagaagctgaaaatcctaataagctccaaatcattttggtaaatcgacacagttcttaaggacctgtggccccttacgtgaataaggaaaagaaaatttctctaaacatacaaggtgtggtggtatttacccagcctggaacatgtttgttttaagacgaggaggtcataattttctggaccctgaaaagcaatccatacatgtttttttaatgtttgcttttgtcagacctgttcgattgccacatgttgtggcaaaaaatgaatactttagtaagtacttatttttaaatggttccccccacagttgcacagttagacttaattacttctgtgctttccagcataaatacgtggatagactcttggaggtacagaagacttcagagcagtggttcttagccatttttgcgtcactgactcttggagaatatgatagaaaaatgtggatcttatttccagggaaaaagcacaaaacaaaaatacatgcaatcttaagcatgtatttttcagtgatgtttgtgtcatagcccttaagtttaagtacccgtggacccctggctaaggcaatttctgtggaggattgtgtaacttaataccttcattgtacagataaggaaaccatatgtatatagcatggaattgtccctttgtgacagatgtgttttacttagctgattggtgccttctactcaagttattttctccagcacgatagaatgttcatgaaaagaaaagcagacctttgcaaatctctgctttgtgaaattccacactgaggttaagcctggctttgagtactagatgctaggattcactctggcttgcttcaattaggatgaggctttttgagagaactcttactaaggtgaaggaccagcgatttacgtagaatcctagaatctcaggagttcttagtggagaacctgaatggcatcactgtcgaatatttgaaatccttgttagcacttggtataaaaactggaggcagttttagagtgcagccagtgtagttaaagtaagaattgaaatgatactaaatggcacctctgtttcataagtgaaggtcaaattctgatgtaaccc

SEQ ID NO: 8341 - DNA, 1485 bp, Homo sapiens
gaattacaggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctctgtaaaagtataag

SEQ ID NO: 8342 - DNA, 1235 bp, Homo sapiens
cacatttaggtcagtctgatcagtgcaaagtacctgagacatttactttggggaatcaggagagttggttatgtgaaaagaatgtgcaacaaacatcaactctggcagtgtgatgtatccatcactataataagaatatgctggccagggagcctgggtaaatccacttcttgttgcatgacttggacacacacaattcaagtttgcttgcaatcttaatgtgactttaaatatctctctttactccaaattatgctggacttacgtcatagcttaactctcaaagagcattctcactttccttatttctaggttttaaggaccatccctgtctcacctccatggactgtctacaatatgcatggtcaaaaagtagacccgttctgcaaccggacagcagagaaatgtgtctgtgatacccacacagtcaagaggcacacttaaaatagcatcagaccctaaaaaaagataggaaatgaccacagaccagtgggccagacagcacatgtatcctctgtccaggacccatggccactgttggcaggcctaccactgaggcaaatcctactaggaggtggaagtcatgaaaagagtttttccacattcctttctgtgatctacagtaaaaacctcagggagatattgaatcatctgctgttttttacaaccccaattaaacaaaattttctgcacctccttctccttccgcattcttccccccacccagtttccttcttcccccttttcgtcaatggagtggtgtggaggagggtaactgaagctaggttggggatttgttcccagaccacaggaattagaaacaatttaaacaaatgtttaaattatcaggatcctctttgtttctagcttaactaagaattgcaaacggtatctatgaaatttctctttttcacttcccatgtgctgtttccaatgcagtttcatgaagacacatacacaaaatcttctaaaatccttgtcttttcacatcacaccaaacagtaatactgttgattacacaggtaaaacttgcctcaaaagatgttttgtagtcgatatacattaaaccaaagcagagtattttggggacccttaacacctaatttttttttttttgttaatcaacactttcatgttttcttgaagctaatatcagtttaggtgcttatcactgtgcaaggcaatatgattctaatcaagccagcaaacgtaactaagaaggcctgctgcctgtt

SEQ ID NO: 8343 - DNA, 1099 bp, Homo sapiens
ccccttccccatggtctccctacccccaacctgcactgggcgctccgcccagaggtgagtccctcccagcccttctctccttctgtcctagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtcc

SEQ ID NO: 8344 - DNA, 2391 bp, Homo sapiens
gagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcagatttttttccattttcttcctttttacaaaaacatgcatacatacacagggtatggtgggtcctaggaaagacacacacacacgcctcactcacacacacgctcacacacacgcctcactcacacacatgctcacacacattttccttcttgaccccaggcctggacccccaaaagccttgaagactttgccagagcagcctcccctcctccatgtctgtatcttctctcccaccccttccccctcagtcaggc

SEQ ID NO: 8345 - DNA, 1131 bp, Homo sapiens
agagtgtgaggggaagggcccctgctgggggtctgctcacagtccgtatgtggctgaagccactggtcttgggtccaggtcgctggccttggttcccccaagcccctcttgcataatcaggggagtcaccccgggaagccaggacacagaacatggaaggactgaaacctttcctggggcaggagtgttttggtattcgaaacccagactcaacccgaatgagaatccggatttcttgggaggcaatgtgaacaaggggtggggcatcaaagccatacattttctactgcgggcggcatctgggtgcacagccatcactgtccctccaggcctcttgatattcgggggacatggcgggcacctccttgctgggctcctgtcttgtgtccatgtcacagtcagggaatgttagagtgaatgccctttaatgacagcctactgcaaacccctctttgcttagtgagaaagccccttgaggggaggtgaattcctgaaagttggtgggaaactggagtacctgccttggtaggaccagaacccatgctagctctgcccctagcagggtgactttggacagggcccttcacctccgagcctcggtttccttatttaggataacaagatagtaatgactaccccccggggccagtggcttgatgtagctgctcatgcacaagtgctgtagatgtaaagattgtggttaggagtggccagcttgggcctggaggctatgatttctgactcctggactggtactttgccacaggcctttccagccctcctcagccccaatccctgaggacagtctgtggctgccccactgggagatgcccagcgttggaattgctgaaggaggcctctccaggaaggcttctccacttgtgtgccctcccatggggccggcctgctcctaccccacccacttccccttctccaggataagcccgctgcaacagctccgtctcccagtgtctcagcctctctggctgctcagcccagcctggtccagctggctatgctggcatggaccctagtctggtggccagttataaatagcccctgcacccacagccttggcagggtgctcctagtgtgggtgcagaggacacttgagaagaggcagccgtgcct

SEQ ID NO: 8346 - DNA, 1109 bp, Homo sapiens
agagtggctaggaggctttgagctgggacctcgaggaaatgttattgtgagctgtctctttggcctgtcagggagatggtagggataattccaattatgtgaatggttggaccacgtgtccaggggtcttatcaaactctaagattctggaatggtattaagtgccacaatgttgctgggaagaggaagtcaaggcagagattcaaagttaaatttttaaggccactggcttagcactggcttggttttagagttaaggcgacaagaccttagctgcagaattttctccattccaatctaaggagtagccatcaattccttacttctggagattgccttatcctttgcagaacacaagtgctaggaaaggaaaaagtgtgggagagtggcacacaagaagtccagagtccagtccactggagacccctcattcaatttacttttattcttttcacaaatacctactgagtaatcgtacgcaaatcctatctctttgatgccttccctgatcacatgatcttaatatctctcatctggacatctgcagcccttataatcagaaaataatataagtccacatggtatttgtattgtaattcaccttttgcatcatgaatggactgagacatgtagccaccaagggcaggtaaatgatttggtgcttttttttcaaaccaggaataaaagctgtttctttctggcctgccagtgatgaggtagaggtaattattcaacatttatttagaaagacaacattgtgggccaggcatagtggctcacacctgtaatcccagcacattgggaggctgaggtgggaggatcccttgagcccaagagttcgagatcagcctgggcaacacaaaaatttaaaaaaaatatattgtgaagaaaggaggactgctcatggcagcctgcaacctcctttgtggtcccaaatcgttcatctctggcctcaaacctaacgctccactctacccttaacaaaaacaccttcctcagcatttagcatgctctttggggtgggtgggggttctcagtctctaccaggggccttgtggaagtattttctctacacagctttctgttaaatagtttcctccatccttttt

SEQ ID NO: 8347 - DNA, 1877 bp, Homo sapiens
ctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgttcccctttctcctgtgtccactgctcatattcacctgccttccctaaaaaaggaatatttgagggatgataagcactagatgccag

SEQ ID NO: 8348 - DNA, 1311 bp, Homo sapiens
gctgggaccacaggcatgtgccactacagccagttggtttttttttttaagttttcttttgtagagttggggtctcactatgttgactgggctggttttgaacttctagcctcaaatgatcctccccgcttgtcctcccaaagtgctggaattacaggcatgagccactgtgttaggcccataattcttaattatcttaaggattctgcctgagctttggcagagctaggattctgtttacatgctagtttgagaaatacttgccttattggatgtgtttaaactgttttttttttttgttttcttatagacagttcaagaagaagaaagagagatttacagacagctgctacagatggtcacagggaaacagtttactatagccaaacccaccacacattttcctttacacctgtgagtcacagaagcatatttcagatgaatttaattctacaatttattacttgatattgaaacaatattcttctcttgctaggtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggtaaacatggtatcatataactacatttttagtcctaatagccaattaactgttcattagctcattacaggcaacattgtaatatacatataaataaatgagcataccgaatctgaaaatatgaagtccgaaatgttccaaaatctgaaactttttgaataccaacatgatactcaggaaatgctcagtggagcatttgggattttggatgtttggatttgggatgctcaaattgtataatgcaaatattcaaaagtccaaaaaatccaaaatttgaaactcctggtcccaaccattttggataagggatactgaacttgtaagacatgtacttacatactttaaatacatatgattcagttaaccatgctgtgagtaaactaaatccacaaataggatattctttttttcttacctcaagatgcaaatgatttgatacattttatttaaacaacttcctaagtacaggctagagtcaaagtatatatactcagcccaattgcttcagcactttctctgtttctatgactt

SEQ ID NO: 8349 - DNA, 1216 bp, Homo sapiens
ttgagatggagttttgctcttgttgcccaggctggagtgcagtggcacgatcttggcccactgcaacctctgcctcccagggtcaagcaattctcctgcctcagcctcccgagtagctgggattacaggtacccgccaccatgcctggctaatttttgtatttctggtagagacagggtttcaccatgttggccaggctggtcttgaactcctgaccccgtgatccacccgcctcaacctcccaaagtgctgggattacaggtgtgagccaccacacctgacctgctggctaatttttaaatttttttgtagagacagggtcttactatgttgcctagatagatcttgaacttttggcctcaaaaaaatcctcctgcctcagcctctcagagtgctgggattacaggcatgagacaccatgcctgggtgggaattgtttttattaggtgaaaagattggttcataggaaaaacgttattgaagaattatgtgacttgaactaatccagactgtctccccagatgatattgctgataggatgaggatggatgctggagaagtgactttagtgaaccacaactccgtattcaaaacccacctcctgccacaaacaggttttccagaggaccagctttcgctttctgaccagcaggttaggagcaattttcttcctttaattaattaattatttgggctcatcataagttttcatcttatgtagtttaaatgccacactcaaaaatacaagcatagctataaactttttagaatcagtaattttagtgtttggaattctgctctatatattaaaattaagacaaggacgttaagacaaaataggctatgtatgagttctttgagaacagtacgttttagaaaactcattgttcctctgaattttaaaattacttatatgcagatcagtgttcttttaaactagcacctaaaattgctgagcattaaatgggggagaaatgtgaaaatatacagcagctctaagatgtctgtgctataatgcctgatttctcaaggtctagttcgggaccagcagcatcaacattacttgggagcttgatagaaatgcagactctcaggctttacctcatatcactgaatcagaatttatattttaaaaacatcctcatttgatttatatgcacatgaaagtgtggggagcactattaagcagtctttttcaataggaaagccattagta

SEQ ID NO: 8350 - DNA, 1070 bp, Homo sapiens
ctccgtttctactttgtgtttctgtgaattttcctagaattttttttttttttgagacagggtctggctctgccacccaggttagagtgcagaggtgcagtctcggctcactgcagcctctgcgtcccaagcttgagggatcctcccacctcaacctccagagtagctgggactacaggtgtgtgccaccgcgcctggcttatttttgcagtttttgtagagacggggtttcaccatgttgcccaggctggtcttgaactcctgggctcaagtgatatgcctaccttggcctcccaaagtgctgggattagaggtgtggtggccagaattttgttttttaatctactgtattggtctatgttttacacttggcagcaaaagctctcagtgcttttggatcttgtttcatttgttggacgctcttgtaaaattttttttttattaaaggtaggctagggttgagggagacagcagagtattgctttaaagtttgctgaaaaacatgccaactttattactgtttcccttggtattgctgatgggcttttctcttttttctaggacttggatgttgtgggtgatggtatgcagtgtcctccttcacctttgctttttgatccttcactaacccttgaagatcatttagtcaaagaaattgctgaagacccagtggatattttggcaagtgaagaacagtcccacctgtttccctcatgtagtgacctggccaggcagagggttccctgctagatagcatgtgctcctggaggggagtggggtgtcatcactagtataaagatgctccacatgtctctcacttattgaataccatataagcaaagcacttttaaaaatgccctactctgctcctgtgtacccttgttgctgtagttctccagatgggctcttagaacacctaatggcccgtgatcctcatatcccagagtaggacatacatttatttaaataaaagcttgagacaaggaatctagggaaatcataccttctgagggagagttcatcactgaaattgttctcattgtagaaggaccagtaaagtaatgtgattt

SEQ ID NO: 8351 - DNA, 1210 bp, Homo sapiens
aatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcatttgattgttgtttatgtgtactgtcctcaaattagtccttagtctttttttttttttttttg

SEQ ID NO: 8352 - DNA, 1189 bp, Homo sapiens
caaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtc

SEQ ID NO: 8353 - DNA, 1983 bp, Homo sapiens
gccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgtaaaattctctgttctctgtagctgttctgggccctgggtgggtcagaagtgacagagcctggtgtaggaggcgacctcctgccccagggctccgtgggcctcttgtctgtggtcagaggacttcctgtggctttctccctgctaaggagaagctgcagtatcttcagagtgtgactactcaaggcctttcagcatcatgagctccagtgtgtgccttcccagatttgtgtgtgacccctgccatgcatgaagccggcggttctttccagtgccttggcccctcacagacctctcactccaaggtctggcttattcaggaatctcccacacagcagctctcacaacaatctggacactggaatcactcccatcctgaccccacagctccccccgtgcacacaa

SEQ ID NO: 8354 - DNA, 1671 bp, Homo sapiens
tccaagatgtgtctatggttgtcaactatgatatggccaaaaatattgaaggtaagttccagggaaagcagcttcaatccagggtgaagtcagattccttatggtgtcccactggaagtcagggtgctgtccatggaaggctgttactgcctccctcagttccaagtctgggattgcttgctcccatgagaagcactcctgtcctttatcttacctgggtttgttgtcccagcagctgggatgacacttgtgtcctcaggagtgtgaagaatgaagctaggcagctgtgggtcttagtgtggtagggaccacagtcagtaggaggacaggggagatgggcacctggagagggcactgtgggcgcctcaggttcaggcagcatgtgctgtattcctgcctttggagatggggtgggaaggatgcctctagaagtggaggcatcagacacggctccccagggcatctgggctatgctgagtgacgttcttcccattccccagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttagatctagttctagttaaacttcccagcttctccctggcaggagggacaccactgggtgcggggtgggttggcttggaaaatgagagacagccacattaagagaagagtagaggggtctctgctgatagtcttgagtctgtaggtggacttgagaggagatgcagaagccacgcaggactgtaatgcatcttccgcccctgctctagcctcgcgtaatgtgtggccctggcctgg

SEQ ID NO: 8355 - DNA, 1180 bp, Homo sapiens
attctacttactcctcacaccctgctccagggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggtaaggagggatagattggcccaagagatctgacatgttcctacactagtttgggaatagagaactttgttccttgactatttggagccatcgctgctagtgggcaccaatgtgaccttttctgtcactttctggtagaagtgttggcttttagtgattaggtttcttcttggggtccctatttctgtgaactgtacttggcatccttccattgtgctagcagatgtgcttactactatcagtggttgcccaggtggtataactctccctgtacctattactctttcttggggtcactgcaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggtgaggtcagctagcaccagctggagtgggtttgtctgggtaggaaaggtgaaagtggcaaatgaatgtttgatttttgttttacgtctataatcagaagctttcttctttattctttgttggatattagggaataattggatcatgatatcgaagaagtatatgttgctggcaaagacctggagaactttgctatcctggagtctctgatttattttatttatttttttgaggcagagtctcactctgtcacccaggctggagtgcagtggcacgatctcagctcactacaacttttgcctcccaggttcaggtgattctcctgcttcatcctcctgagtagctggggattacaggcgtgtgccaccacttctagctaatttttggttttttgttttgttttgttttttgagacggagtttcgctcttgttgcccaggctggagtgcaatggcgcaatctcggctcactgcaacc

SEQ ID NO: 8356 - DNA, 1221 bp, Homo sapiens
tttggagacacgcttcacatacactacacggtgaggggtctggggggccggggcggggcctgggagggggcggcgccctgctgaaacacgtcagctttggcttggacacgtggcaagcggttcgggagaagaaactcggggctctggggtcgtcgagcacgtggcgaggggagagacgttgctcttccgtgcctcttttccctccttgcttttctgccagttcctacctggcacggagaagtgcagggtggagagatctccgagaagcgccagccttctggggcttcctgttccttacagcggtaaggggaacgctaggctgccgcactaagggggctgccgccgcccagcggtccaggtgtgtgttgcgcgcctgctgggagggagagggtgctagatgtatgctcttgatgctctctccccccagggaagcttggtagatggacgtattattgacacctccctgaccagagaccctctggttatagaacttggccaaaagcaggtgattccaggtatgtgacctgtgcctcccattccacctcttcccaacctaagccctttcttagcctcttcggctccaaagctgccctggaaatcccccctgaaatgagtaagaccctagggctctacgagttacctcctgaggttcaaacctcacttctagtactccacttgtcccatatcctattggaagccagagatttaagaagtgagggaaaggtcaattgaggatggaggaggaagactttgatcttcatgtcatgggatttggggaaggtggatagcttccagttcagttgtgtcttcttcttcaaggtctggagcagagtcttctcgacatgtgtgtggggtgagtatctcggcaggggtgggcctgggtaccccctttgcatgggtagaggctttctcggccatcctcactccttaagcaggagaatgtggaataaaggaccctgcttcccactggacaggtccaggtcagtgggacctctgagggcattcaaagcctctgtgcctcttgcgctgttgcttttgtcgggggagttgaggcacatggggagatggacacctttgctggccagcctgtttggtgttcaggtggaaaaattcgtgttttgggtgtgaagattcagggggttttgctgaaggagcttcagctggactgaggctgctggcctacctctcctgcctctggctgtgactgacattccttccctc

SEQ ID NO: 8357 - DNA, 4701 bp, Homo sapiens
cgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagtaccagtgtgaagcatataatttatattcagttacttccctgctgcctcccctgccaattttccttttcagcacttctattattaataggccatcaccctcaaggaccagtgcttccacccatatataactctcaaactactccaaccagacatgtcttatcaatcccaatgactttgaacattacccacctactcctcaagatcagatgacactttcctccttccaggcttctccaaagttctgcttggtgacagggtgctgataagagtatctttcccaagtgttttctttcttcttcttctttttttttttttttttttttgagacggaatttggtcttgttgcccaggctggagggcaatggcacgatatcggctcaccacagcctctcctcctgggctcccgggttcaagcaattctcctgcttcagcctcctgaggagctgggattacaggcatgcgccaccacacccggctaattttgtatttttagtagagatgggtttctccatgttagtgagactggtcttgaactcctgacctcaggtgatctgcccacctcagcctcccaaagtgctaggattacaggcgtgagccaccacgcccggccaggtgttttatttctatattagcaaatagatatctttcagagctacaacctctcataatgataagggagaggactttagc

SEQ ID NO: 8358 - DNA, 2590 bp, Homo sapiens
gacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggat

SEQ ID NO: 8359 - DNA, 1105 bp, Homo sapiens
tttggcaggagagtggtaggaagtgggagatgggagaacaggctcagtgtaggggaattggtgccccccatctccctccacaccccacccctcaccctgggctctctgtgccacccagggtgtcagaagggtccctgtagctagttgcttcctcaccagagctgagacccagttgcctctactcctttcccaaggctgcacttccagtgcttgccagcagcacacgcccctaactggtgtgttgcacatcccaggaggtggcagaggaggtgggtggtatgtacttggtctgagggagagctgtcttgtcatggattatatcacctcccaggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcaggtatgagctggcagaggggccattgtggtgcatagtctgcactcaaccaaggagcaagggcaggattggtcacaggagagcaggaggaaagctgtggtggggagaagggaaaggcaggagaaatgaagtacatgcaacaaaagcccccactgcctgagtctcctacctgatcccacagccaccactgccactctctgatactcttgtcccttcttctgcaacctctgcctttctagaatcgaggcatctacatgttccgaataaacaatgaacatgtgattgatgctacgttgaccggcggccctgccaggtgagagatgacgaggaaggagggatttagtggtccctgagagtggcactctgggggatagacgaacaaggaatcaaaattgtcccaagttagttgcctgacatccctgactctgtcccactgcccaggtacattaaccattcctgtgcccctaactgtgtggccgaagtcgtgacat

SEQ ID NO: 8360 - DNA, 1125 bp, Homo sapiens
atgtaactgtactgaatactgtaggcagttgtaacatacggtaagtatgtgcatctagacatagaaaagatacagtaaaaatacagtacagtattataatcttaccagaccactgttgtatatatgattcctcattgaatgaaatgttgttaagctgcacgtgactgtatttggctcaaggtctcatgaccagtactagaacctgaacccaagtctttccaactccaaagcatgcctgctctttcactagggaccttccatggcctatgctgggtctcctgggccctgggtttgtatctcaaggctctgtgatgaccccttggggttggaaacctcctgcttcttaagagagagtgagactaggaggccaagagaggatctggaagaccaacacaacttcatgatagggaggcttgaaggcctcagaaaactgcagttctggattggggttagggactggaggtcagtgagcagaagttgcctctgaggactgctctcttccctgcttcttagccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcagtaaggaaggggctgggagctggggggcttggcgggcactgagaactttggcctaaccccaaaaaaactcaggctaaggtgagtatgaactgtgcccacagctgcccggggtggagagctgtcaaaactatttattccgctatgggcgccacccccttatggagctgccactcatgatcaaccccactggctgtgcccgatcagagcctaaaatcctcacacactacaaacggtgagcttgtgatgctggagccaagggatgtgggtgtgggtgttgacagggatcctctggtcccattatgaggatttaggatacagatcagagttcccgtggagaaaatggggaatcactcttagacttcctaattagagggcatgcaggtattagtagggtatccttttcctcctctcccaacctgctcagatgcacttgggatataggacagaattatcttgggcaccctggggaggtaat

SEQ ID NO: 8361 - DNA, 2012 bp, Homo sapiens
tcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacaggtaacctcagctggtaacatagccaagttactcagggtgattattgttatccctaaatgggcactgaggctagagacctcagataatccctacttaagatgggacacaaagaactttggctaaatatcatactagtggtagaggcagaaacactgtagcttttaagaagagagagaacagttcctggcatatagtaggcatgtagcagatgtttgaataaatggaatgaatgtatgaatgaagcctaattagcagagcctttgtagctgtagtgaagttgaaagcttaagacttgaagagaagtggtgcaaaaaaaagcagttgaggccaggcacaatggctcatgcctgtaatcccagcactttgggagaccaaggcaggtggatcacttaagatcaggagttcaagaccagcctggccaagatgatgaaaccccatctctactaaacatacaaaaattagctgggtgtgagccgggcgcggtggtgcatccctgtaatcccagctactcgggaggctgaggcaggagagttgattgaacccatgaggcagaggttgt

SEQ ID NO: 8362 - DNA, 1669 bp, Homo sapiens
gacaaagccccctacctggtgaggcagaaaggagcatggattagcgtgggaactgagagggagggagggatctttgggtaatttacctcagttctttccgctccccactcctaaagcagctgggccagaagggatctgcttctgggtagggagtgtgaaaacactacagtatgggggcggggcatgagaccaagcactaggccctaaggctgtgtcccatatccctcagcaaaaggccaaagataaccgggcagctcaccgcatcaacaaggtgcagaaggtgagtggggctgggctggggtgtagcagtcctctagtgggtggcctctcttgagggtggagggccatggggcctgcctgcagcagcctgactgccctatgcctggtctccccctgtagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggc

SEQ ID NO: 8363 - DNA, 1230 bp, Homo sapiens
taaggccctttttgcagttggggtgggccggccaagctttggactagggaccccaaaagccaagggagatggaggctcagaaaggaaggaactccccacatcgcagaaaggttagttatgtgggagtgagtggtgtgagagaatccaactttcttctggcttaggagctggcaagttatttgatgggaaatggactggcctccaggagtcaagggtggggtcaagggtcctggcctgtagggctgtgggactggagacctgttctgggcatcagatgtaggacatctctgattggaggggggactcttgctcataggagatgatggtccagatattgcagatgaagaatcccgtggcctcgagggcaaagccgatacaccaggtgagggctgccggggttactgtgtcctgtcttggccttgcttgcctctgtccctctgctgtgcccctgagcattgtcagtgttggaggctggaaactgtcccatggccctctgtggttcagagtggccatgacccatcctggccttgacccatgggtttctcctggcatttacaggacctgaggatgggggcgtgaaggcatccccagtgcccagtgaccctgagaagccaggcaccccaggtgaagggatgcttagctctgacttagacaggatttccacagaaggtgaggctgtgacccgtacctctttgtgtataagggttttctatgggagaaggaggaggtcctatctttgggactgtgatctgtacagcttctctggtggggagtcctggactgttcctggccatgatcatttgtagacctgtggtgtcacctgaacttcccagtcttcctcaacagtgtccttcattcccccacagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtaatacaggtgggagtggtctgaagactgacataaccaagcttgcctccaggatgggccagttgctcttttctctgatcctgtccgtcttgtaggtggactccctttgggcaatctgccctccagcagcccaatggactcctacccaggcctctgccagtccccgttcctggattctaggttggtgtctctgcgtaacctttgtgggcagtcctcgttgtccttt

SEQ ID NO: 8364 - DNA, 1042 bp, Homo sapiens
gagcctaagtttagagtcactgttttggggacaagggtgctctgcctaagtctctgtgtgctcaaatggaggcctagtctctgcattgggctgcctccagcctcacccttagaagttccacctcctaggctgggcacggtggcgcacacctgtaatcccagcactttacttcgggagggtgaggcgggtggatcacctaaggtcaggagttggtgaccagcctgactaacatggtgaaactctgactctactaaatacaaaaaaattagccaggtgtggtggcaggtgcctgtaatctcagctacttgggaggctgagacaagagaatcacttgtacctgagaggcagaggttgcagtgagccgagatcgcgccattgcactccagcctggggaacaagagcaaaactccatctccaaaaaaaaataaaaagaagttctacctcttttccacctcacaccctgagaagttcccatcttctgccccagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtaaggagactgggatcttcagtggagccctggggccttgagatgttaaagtggatatgatgttgagtatgtgacagaggctgggtttaggaggccaggctggtggcttgggtttccggtgaggggacttctgggtacttcgggtaggttgggtgctaaagctctgttttcctgctcctatcaggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtgagaacatccctttctcctcac

SEQ ID NO: 8365 - DNA, 1207 bp, Homo sapiens
cagttattaaggagaaaatactaatacgtagaagggacaagtaacttgcccagattcatggttactcagtaatagaattgggaccagaaacttggttctttcaagccattgttttttctccttgcccatctcaaccactcttgggaggggaagaatgggtttgggctagagctatgcgcttgttgatatctgggagtttggccttttcccttgccctgagtgggactcctgggcttattacctgtcttactctgtccgtttgtcacttcttctgttcaagtgtgtaaacccaacacactagcccttgacatgctcctgtcattgtccccttctttcactcagggtcgcagcagcagtttcccaggaagacgccggcctcgtggaggagcccatggaggacgtggtagaggacgggcccggctaaagtcaactgcttcttccattgagactctggtagtaaggagatgcctcctattcctcccatcccccaaccatgctttagcaccctctgagtcctgccagtcccttgcatgcttgcctacctgcctgctcgtctagggcctgtctggctatgtctgaattcctgtccacttggcccgcaggtttttctgaaatctctgctatcagactgaggctcaatttgggagctggggtgttctgtctgttattcctggcttttggccttcatcttaaccaagggttcacactttcttcccccaacaccaaagaggaaagtagcttggtgggggcagatttatctgcctcactttccataactctctgcccatcaggttgctgacattgatagctctcccagtaaggaggaggaggaagaagatgatgacaccatgcagaataccgtggttctcttctccaacacagacaaatttgtcctaatgcaggtaccatacagtgagacctggcacactgaacattgtgtatgtgtgtgtttggtgagaggatagatgggaaaactggacctactttggggatacccagctaatgagaaaacagaccatgaattctaatcatgttattcattggtttgtccatccatcacatttctcttgagtatctcttctgagcttggcactaagctaggagctagagaaatagcagtgaaaaagtctttgccttattgaactttatagcttagggaacttacatgtgtcctcacttgaataatcttgaagctgatagaattttg

SEQ ID NO: 8366 - DNA, 1184 bp, Homo sapiens
agtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccaggtaaggggatgttagtactctgttattctggaacagctgtaactcttcatggcacatctaatctaagagcccttcttttttctctttccttccagatccccttcctcctccactctcac

SEQ ID NO: 8367 - DNA, 1268 bp, Homo sapiens
gaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggtaggaatggaagggcaggaggaaagtcttaggcacaacacaggttagggttgaaaatgagggcagtcggagaaggcctgttaacatgaaaacaacaaaaaagaaaggaaatgagggcagagaggacactgtaatgttccatgtgcacctgcaggaaacctgggaatgactctaagatgttggtttgtgagacgtgtgacaaaggataccatactttctgcctaaaaccacccatggaggaactgcctgctcactcttggaagtgcaaggtgagtgtaccctgattctgccctattgtccctaactgtgtctgctacagcattctctgtcttgacaagttgtgtactttcgtttagtctttgctgtctgaccaatgcctgttttgcccactcccttcccttaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcaggtaagtggtggggactgactgagattgggctggcaggttggaagaactgacattggcaggggccttgttaaattgagtggactttgagaggagagccctaaggtgggcagtgccatccacagcattcgtgcctccccccagtgtgctctctaggatttgttagctggtgagagccacagtgcctgctcccctgtaccctctgcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactaggtgagtagggtttgagggtccctgaaattcatccccttttattctatggcaagagacagtttgtgcattgccccagaccccacactttctgtggagtagatctgagctagataggagcatcgtgttgttgtgtctgcagggaaagcaggggtccaacttgagccccagttggaggcccccctaaacgaggagatgccactgctgcccccacct

SEQ ID NO: 8368 - DNA, 1102 bp, Homo sapiens
catctgctcgagagaatcaggtgctgggcctgaagactagaagggtggtgatggtagctgtgttttccttattgtactgcttggtggtgggaatgttgcgggaatggggctttcaccccagagctgggtggtattggcactgaactgacttttgccctgaatcctctcctcttatagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttttgttgttgacttctttttcgtgtgtgtgtgtgagacggagtttcactctgttgcccaggctggagtggtgcagtgctgcaatcttggctcgctgcaacctccgcctcccaggttcaagcagttctcctgcctcagtcttctgcaggcacccgccaccatgcctagctaacttttttatttttagtagagatgaggtttcacctaggccaggatggtctcgaactcctgaccttaagtgatccacccacctcagcctcccaaagtgctgggattacaggcgtgagccactgcccccggccttattttattgttgacttctatgtatctagtgagagctcagagccaagatctctttttccaaggagtgatggctgtggtctttggtgggatatctttcctcctaccttgttcctattc

SEQ ID NO: 8369 - DNA, 1139 bp, Homo sapiens
aacgcagcctttgcaggcctcaccacactctgtctggtgaagaccttcactgcagctgtgcgggcagagctgatccgggcctttggtgagagggagtgagggtgcaggctagtggggggtggtaatcatctaggacactctggaacatggatcaccccagcaggggagagggtgtgcttcctgctttgtgggtaacgtacctcatccacacattctgtggcttggctgcctggtccctaacggactggacctttgacttgcttttgactgcccatctcctcttctccagggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagcacctgtctctgtgtatatttgaacagccttgctcccaccagcccggcgtctgcccagtaagagaagcagaggggtcctgcccaccatccttttccttccccttcatctatattattaccatcctttggggacttggatctggtgttaggccatgcagttgggcagtgggaaactcctccatcctcagtcttgcttaaagctggcttgtcccctgactcctccttatattcatggccttgtttctgta

SEQ ID NO: 8370 - DNA, 1629 bp, Homo sapiens
tacaggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaagctttgtttcctgcgtttttttctaaaagtgccttggtttttagattcatctatacttggagtatagagagtctggtgtcaaggatcccacttactgtgcaggcacctctagggaaaagggagctcaacagactagaaaggcaggagccctagattctcagactagtttaccacctcaacgcttgcatagggggtggggaaagtcattctgctaatctaaagctcatttagctcttcagagtaagactgggtagttactaatgagtaatgtataggaagtgtaagttttgaatatccactgagatgctgctgtttaaagtggcctgctaacttgttagtgtaattaagaaatttccaagtgatctttggctggtcatggtggctcacacctctgatcccaggcattcaagaccagcctgggagacatgatgaaactccatctacaaaaaaaaatttgggtgtggtgg

SEQ ID NO: 8371 - DNA, 1320 bp, Homo sapiens
aactagtctgagaatctagggctcctgcctttctagtctgttgagctcccttttccctagaggtgcctgcacagtaagtgggatccttgacaccagactctctatactccaagtatagatgaatctaaaaaccaaggcacttttagaaaaaaacgcaggaaacaaagcttttgatgttaatgactttactttgagatatgatggaaaaatattacaggtacacatggaaaagacatgatcaccaagtgaaaacaatctaaccagaaagctttaacgtctgtcagttaagctgaagctgaaattctgggagcatgacatgctgcagggccaaaaggaatggataattagtattcctctccttcttcctcaccctctccttcaacagaatccacaccaacctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatgctgcgcttggttttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcgggggtagggcaccaggttggtctggaattctgtcaggtcaacattcagggctccatcaaatctcagggaagcagtgatggaggacacaatctggctaataaggcggttaaggttagtgtaggttgggcgctcgatatcgaggtttctacgacagatgtcatagatggcctcattgtctaccatgaaggcacaatcagagtgctccagggtggtgtgggtggtgaggatggagttgtagggctcaactacagctgtggaaacctggggtgctgggtaaatggagaactccagcttggacttcttgccataatcaactgagagacgttccatgagcagggaggtgaacccagaaccagttcccccaccaaagctgtggaaaaccaagaagccctgaagaccggtgcactgg

SEQ ID NO: 8372 - DNA, 1212 bp, Homo sapiens
gatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatgaattcagtcctgtgttttctatctgggtgtctgaagtttttcatgtatttagtgcattgagaataaaaaataagtgttgcctgtggtttatacatatcctaggaagtgacgtttgtatttaaagtatcttagtaatttaaaacttttatttatgaaacacaaaatgtatatctaaagattaccattacagagcatcatgtactttttttttttttttttttttttgtgagatggagtcttgttctgttgcccaggctggagtgcagtggtacgatctgggctcactgcaacctcaacctcctgggttcaagagcttctcctgcctcagcctcccaagtagctaggattacaggcatccaccaccacacctgactaatttttgtatttttagtggagactgggtttcaccatgatggtcaggctggtctcagactcctgacctccagtgatccgcttgcctcggcctccctaagtgctgggattacaggcgtgaaccactgtgcccggctcat

SEQ ID NO: 8373 - DNA, 1205 bp, Homo sapiens
ttgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaa

SEQ ID NO: 8374 - DNA, 1141 bp, Homo sapiens
ctaacatagtttataatttaaattgtttgtataaattatctttattttacagttaaatgatacaaggtaaaatatgtttcaaaaaatcttacataaaaatctaagttgttattgttgctagttcatttacctttccacctttctttacagtatgctaaaaatgagggaatattgatgccacattaatacctgataccgaaattaaaccaccttttctttatatgaaatctagcatataacttctatttctagcaatgttctgcatttctaagttttgaaattaatttttcacatgctgttatcactcatctattaatcattcccagtgagatgcttgtatgtactgtcactgacactaaagagtgatacatattgttaaaaatgaaatatcactcttttcattattctctgtataggcctcagctgcctagtgacctactaatgttagaattaaatgaccctgtcatcttttccagataaatgcggtacgtgcaatagttcctaataagagcaacaatgaaattatcctggttttgcagcactttgataactgtgtggacaaaacagtacaagcattcatggaaggtaatcctgacttaattttaaaaataaatttatatttgctcaaatagaatttgcttcagacttttataacattcagcaatccagtgattcatagatgatagagcagaccccatgaaaacataacataccatgacatttgacgatacctctttcagctgaaataagctatgtggtgtctataataagagataagctgagaaaactccattgtttcacgctaaatgttctctaatggtatttaagaggaaatcatgtggccagtggtataagggacttgattggacttgggttgaataagaatttaagagactcttaataacaaagcagtgattcagtggctcaccaacagatggcaaattcaaggactcagtattgtcttccggattctaatatcgttagtttggctgtggcaagtgactcaaatgtgtgggtttgaatttccttatctaatacgtagaagaatggcaggcttagtcaacccttcagatttataacattgagaagtgttttatgaaccttccttccatgtaacctgttggagaaaaactatctgaag

SEQ ID NO: 8375 - DNA, 1591 bp, Homo sapiens
ccctcacagcgtggcaggaaatgctggagagcatatgatgtgatggaaggagaggttgagatttcgaatggagagagcaggatctaaatcctgcctccgtcccaaactagggtcacatagtttaacccctctcctgtgtctgtttcctcatctgtaaaatagagctaatggtagtgcctcccctgcttagttcaaggctgtgtaatcaaagccctttgcacaccaagaagcccatacaaaaggtcaattttaatttccttccctttctagaaccacctctaccctcaactaagcctaaagatgctttgtgccaaattagagcccagcctaatctggtatgggcacccttgctggtgctgggctctccacccagcgcagtctgcagctggtccacttggcttagtggtccgctcagcatcgggttcagcaagacccttggtgctcacgctttctctgtcctttgttcagtgcagccgctgcccaaaggggaccaagtgctgaacttctctgatgcagaggacctgattgatgacagtaagctcaagtgagtggctggagacacaggaaggggtggagagagccgagtcactcctgtcaggtagagcgccccaggctgcccagccccagcccttgggctcccgttggtgcttggccccccctggctgagccccctcccctcccactggggccttcttaggctccgctgctttacccttatccccagcccaaccccagagaaggaggctgggccaaggcctgatgtaccaccttccaggccacttggctaaaggggctcagggatgccctaatgagccaagtaacaggcaagctgaaggtggacctaaatcttccttctcttcttgcccctcagggacatgcgagatgaggtcctggaacatggtaagtatggcctcatggggtggtgaggggatggaagctcctgccagaatcaagaggaccagtacaaggtgctggtggcctcagagcatccctccttaccaccccacctcaccccagagctgatggtggctgaccggcgccagaagcgagagattcggcagctggaacaggaactgcataagtggcaggtgctagtggacagcatcacaggtgaggaggcctgggcaccagaaggctcactcttcagcatccttcgccccagcctgtgcccctgttgctgcctggctggggagaccctcgtttcccaggccccgacccccttcccttataaaccttgccctggttccctgccttgcattctggccctcaggggtaggctcttccaaactccctcttctcccaggcatgagctctccggacttcgacaaccagacactggcagtgctgcggggccgcatggtgcggtacctgatgcgctcgcgtgaggtgaggcaggcccatccccgcccttcttaggctgcttcctctgtcagtgcctttctctgcgtagtccttggtttcccatctttctctggcctgcatagacctactcccccaattcttcaggtcccagccctcacctgccccatttccccagatcaccctgggcagagcaaccaaggataaccagattgatgtggacctgtctctg

SEQ ID NO: 8376 - DNA, 2254 bp, Homo sapiens
gcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagac

SEQ ID NO: 8377 - DNA, 1853 bp, Homo sapiens
ggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaacatgaggctggttttcttgtcttgcaaggtaattttcaatgccttttagaaaatcatttctggggctgggcttggtggcttatgcctctaatcccagcactttgggaggccaagataggtggatcacctgaggtcaagagtttgagatatggccaaactctgtctctacaaaaaatacaaaattaactgggcgtggtggtgcacacctgtggtcccagctacttgggaagctaatgtgggaaaattgagcctgggaggcagaggttgcagtgagctgagatcgtgccactgcactccagcctgggtgacagagtgtgagaccctgtcacaaaaaaaaaaaaagaaaaaattacttccttcaaagtgtcttgactctgttgttcatccccatttcccactctctggacccaccccaggcttaccaccaccgggagtttgtttcttcatttctcatccagtct

SEQ ID NO: 8378 - DNA, 1218 bp, Homo sapiens
ctgaggcaggagaatcgcttgaacccgggaggtggaggttgcagtgagccaacctctaccacgccattgcactccagcctgggcaacaagagcgaaactctgtctcaaaaaaagacaaaaaaaggccaggcccagtggctcacgcctgtaatcccagcactttgggaggtcgaggtgggtgaatcacaaggtcaggagttcgagaccagcctggccaacatggtgaaaccctgtctctactaaaaatacgaaaaattagctgggcgtagtggtgggcacctgtaatcccagttactcgggaggctgagacaggagaatcgcttgaacctgggaggcagaggttgcagtgagctgaaatcacaccactgcactccagcccaggcgagagagtgagattcggtctcaaaaaaaaaaaaaaaaaaaagttagttgattatgatgataattttctaattcatatcactctgttccttctgccctgttttatcccaggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagaggtatgacttatgcaagccgtcattgttttatggcctctttattcgcctttcaaaggcttagtgtcagtttttgttctaaaattaatcatctcaaatatatttctttccacaaataatgactagaattgtaagatacttacttgtagaagagtcctgtttgggtttgtctgtctaatacctttctaaaccaaacttctttccccgcccctttttccttcttgctcttccctgcttctccttgcctcttcttccttccttcctccccttcatcccattttggaaaatttcagacatatataaaactagagaaattagtataactaacccctggttcttatcacttaacttccatgattactaacttgtgtccattttttttttttttttttttttttttttttttttttttttagctctattgcctaggctggagtgcactggcaggatgtcagctcactgcaacctccgcccccctgggctcaagcgattttcttgcctcagcctcccaagtacctggaattacaggcatgtaccaccaccatgcccggctaattttttttg

SEQ ID NO: 8379 - DNA, 1119 bp, Homo sapiens
taacatctctctggtgcagcaatgcgtgactgtaaaggaaactgtttttgttttatagctgtaactgtcctggtgcatgacagctgccccaaaggtatccccctttgattgccttctgttcaggagctttcagtgttagtgttacatctggagccaggtgactaatgagttacatattccatagcagatgccactggctaagccaaaagtaagtggcctattgaataggaattgctacccacaaagttctcatcagagtgacaaacatatccaggatctgctcctagttattttcagctggatttgcccatagttcagctggttccttaattatgaatttcaaataaagctaaccgtaggactcatttattagagcagttatactctgtttggtgcttgaattattaaagattccccctttcctcagaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggtgtgtattgttttccgtgctagaacagtgatgatgcaggagggggaaggcattgtctgacagtttccacttgccaaatatacctagtttcttcttccacattaaagaactgaaagtgacctgttctttaacagcttgcccatgattagagctgaaattgcagactaggaatcttgttcttcataatttgaaatttaaatgtttttgtcacttagacttgaaacttacttaacagacagatttcaaatgagaacttaaagaattagaggaaaagggagggagggagatcctaacgtacttgatctgtcacaagttattggccatccttcattgtttattttaagtgctacccggaatatccatccttacatgagtagctggtactttgtcatacatacaggcaagacaactgtgactcttcttttcatcacccctctctaattcagggtaaaaggctagatgtattcaaccagttgagcaatgtgactg

SEQ ID NO: 8380 - DNA, 1106 bp, Homo sapiens
cggatgactatatctggggtctccccgggcctgggaagcttctctggggagcattctcttggcctgacctgaccccctgtgcctctgtatttggaggaaccctggatgtgtcccttggtcagccacctctgggcttgcaaagcagggaagtcttctgcccgaggagtggtgacctctggagatgaggattctggatgggcacatgtggaggggctccatgtgtactttcatcccaggacaatgatagactgtccctccctcctcccccaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtgggtggctcccaccctccctcagccctgctcctggagttgcttgagttccagtcaggatgtctgcctccctgacccaccatagagcccagccaaccctgccctttaacccacccccacccccaaacctgccactcacagcagaggagttagggtgctgctgagcacccagttaagggcacccagcctccgatcccagcatagtccagaacagctcgacccccacccagcctgaggtatgagacattgtcaccctctctggagtgagctttaccttcattctggccactctgtcttgaccttctcgtcagttgggggatggggacagaacatctttaaagggtagaaactacagtataaaagccacagcccctgccttgtctctctgcccaccttatccatgcttcctctcacccatgtgctgggatgggatgccctgcccctgggcagccactaca

SEQ ID NO: 8381 - DNA, 2006 bp, Homo sapiens
tgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccacgcttgtagtgtttgttcattttatttgacaagtatttattgagcacctgctatgtgctagttgtgatgctagacacgggagataaagtggaaaatgagatttctacttttgtggacctcagggtcttaccttaagagattgctgtctgccccagtggtccaagcagcctagttgctggttgggattattgggcttcaccactggatcttaagagccctttcccgacttgctaggcaggtactaacaggttggtggcagtcattttcccccttgtccatctgagctccccagagcacttgttggctggagtgagccatagatgcccgtgatcccttaggtttgacga

SEQ ID NO: 8382 - DNA, 1618 bp, Homo sapiens
actcctctaccaaagtagcttcaattccacagagaacagaattggagatgacaagggagaaaactagaaagcaggtaaagcatagtcacaacagtagccatagtccagacaatacttctttgagttagatgtcatcagaaagcagaccagactgggaacacagtgcccacacctgggtctctgagcttaggtgtcttacagttctttcctcacttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccacctctactgtctcaacctcttcagtgactctatccgcagtttcctgaatccataagctaattaagagcttttccaggtctgattcagaaggccctggacaccaaatttttcctttctgtgcatggtaggaagagtcagccagggtgcttacattttagagctttatgttttttaagaaaaagaagaatcacttgaacctgggaggcagaggttgcagcgagccaagatcgtgccactgcactccagcctgggcgacagaccgagactctgtctaaaaaaaaaaaaaaaaaaaaaaattaggtcatacttttagttcctcaacttgctatattgaatagactaatattgttgtgaaatatgaatgaatatgcttttgaaagtcagatgagaaatgtattttgccttctgaaatttgaacaattgccttgttaatacaaactggattggttggtgtagctaatctgacaaaagatgcaatt

SEQ ID NO: 8383 - DNA, 1474 bp, Homo sapiens
cacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaatgtttctcttccattattttcttacgttattactgtctctcaggatctacttttgcagtttgggaagaaaaaaatggtaccacttttttaagttttagttgaatagaagcattatcaatacatctcaccactagatggtagtgttgggctgatcttggatttcaatcctccctgaaggaagacaaatttttctggaaaattgcaggcaacttggcaagagaattaatgtgtgcattcaaaatgaggtattttaccaattcgaaatctagtggtggtttttattgtttataacactcaacattgaataattcaccttacaattatgcctagcatgctgaatggatttccaaatgtct

SEQ ID NO: 8384 - DNA, 1121 bp, Homo sapiens
tgctcttcctattacaccacgctgcgcccccagctctctccctggcactgagtggccagtgctgcagagcttggggagagagggcagccaaaagaaacttgaatgtaggtagaaactaatttggacctggctctactgagatgctgactgtacctcccctgggatgtaattcagaagagggaaacatttcactccaaatgtgactttggaacagacttcagttcagggaaaggccaattgatgtttgcacagtggggtcagtcataaaatggaactggaagggaccttaaaggtcatctggtgtagcctccttttataagaaaccacaacccaaagatattggatcatttgaccaaggttacacagtttgggggagaacagtggaggagtgtggtctgcaagtttagggctctaccacaccactgccaatccttggatgttggagaatcctcttctgtgtctaatgttctgactttctttattgcataggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaagtgctgatcctggtccaaaaggaccatctgtctggagcacacattgccacctgtcagggaaattggtgaaggaagtacataatgtaaaataattttattgggcgcctcgtggattttaaacactatatgaggtactgtggagaaggaggaggagggtaataatcagaagatacattctattctttgaatttttgtttagtttgtggaagaaacagttatagacacaaaaattattttaaaaaagataattatgaaataattataaagcaaaatatcagcaagtctaaaatgaataggagtgaggattaggtacagaataagagacagagcatcacagacaggagctcatcaggaaggctttctggttgagatgagtgttgaggcgagttttgatttggttgaatggtgcgttaagcactctctatacctgcactttccaatgtggtagccactatataggtggctatttcagtttaagttaattaa

SEQ ID NO: 8385 - DNA, 1134 bp, Homo sapiens
gtgtttttgggtccagcatgcaacccatctataataattatatttataaattagtttttatctaccatcattgactctgctatttactcactgttcgaccttgggcaaataacttaatttctctatgcttttttccctccatctgtaaaacagaagcaatcttaattacagcacaggattttctgataattaaatgaataaagtgcatggagtagtctgatacatggataatgctatatacgttttagcaattgttgatcattttagtttatctgtaattgtcaaaacttatctccctcggaatgataactcttgcttaaaaccatgcggacatatttcaaactggtagaaatccttaaaatctttttataggtgacatactgcccagagttcctgagaatagaatttaaataattcccatttactttcagtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggtaaactttatggttttattgttaaaatgagaattcagtacaggacaccccccacccatggtctctttatacttgttctgataaacctatggcattattttcttatttgaaaagaaggttacgttaatgaaatgttagttgattgttacattgttttcagataacatgacttttgtaatgttaagattgtttatgagggttctattaaaggaaagcgtgaaattaaagataacagaaaaaaaggcggggtggctcatgcctgtaatcccagcgctttaggaggcccaggcgggcagatcacttgaggtcaggagtttgagactagcctggccaacatggtgaaacactgtcctatactgaaaaaaaaaaattagctgggcatggtggcatgcacctataatcccaagatcatgccactgcactccaacctgggtgacagagtgaaactgtgtctgaaaaaaaaattttgtgtgtctatatataaacaactgcctactttgaacatagagttgaagtgatatggtaagca

SEQ ID NO: 8386 - DNA, 2223 bp, Homo sapiens
cttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagcaggactggtttccttttctctaggtggtgtatgtctaatgactacttctgtctacctttcagtattatatgttgccctcgctaattctattattattattgtctaagttgttttttggatgatgagggcagtgggaagtaatggtgtttcacttaaaacaagggcagagagacaagatacagctttatgatcctgg

SEQ ID NO: 8387 - DNA, 1289 bp, Homo sapiens
gcacagatgcatgttagactcagtattctgtccccacccacctccccacatctctgtcaactctttgtctggtgtgttaaggagtcacacatcattctggacttcattttcctcctccgtaaaattatccctggcttcttttatttttgtttttgatttttatttctaattggtcttaatcaaattataaataaaaatcatctgaacgtcccctttacctttttttttttttttaaacaattgaggcagtgatagttcagctcacagtggtaaacactttcaagagccggaagctaataaatgcaaatgtttgctttttcagatatccacacagaagcagttcaggctgcactggcaaagcataaagaacagaagatggctttgcccatgccaaccaaaaggcgatccacatttgttcagtctcctgcagatgcctgcacacctcctggtaggtttatcagagctttttctctctgacagttaataccttgatgttcctgaaataagttctgctttttcttttctgaggtaagaaccagaatcttctccccgccattagaggaatgtaagagaacactctgaggtggcagattttgcttgtcatctcgtaaacaacacacaaaaagatgtcttaagagtaaaactattcaaaactaaacaaaaaaactttccttctgaatttccagtcttttttttttttggctgtaatccccagacttatgtagtcataaatacaggccaaagcttaggccaaaatcctgctgtgttaaatagccactttcattgtcacccaatatactacttgtagtcatatatctaattcatttgtactcctaaaccaaatgcttcgtctctgcagcaggcatgagaattgttggacttgggacaaaagtttttgtgtcattaacaattatggaagagcaatcatgcaaagttgtgatggacctgcaaaacgtatataagtgtgtttatgtgtgtgtgtgttaatgtattttgtacacatttatttattttttaagaatctactttttataacggggtcatgagatcagtgagaactaggtatcttcatcccatccctgttcaccagacttcaatccttatgctccctaaggtaaatttaaagagttataacttcatatttgaggaataactagaaacaatctaagttgtcttgtctgttcagaatctctcccaaagtttttttaaaaccttaaaaaaaattttttttgaacttctctagtggaagctcgaaaaaaattttttttagatcgaatcccagacaagat

SEQ ID NO: 8388 - DNA, 1334 bp, Homo sapiens
tgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaat

SEQ ID NO: 8389 - DNA, 1207 bp, Homo sapiens
ggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacaagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaatccttcacacattgggtggaggctagggaattgatagattttaaatttaactttagatggtaagacccagtgatagctggggtagtctaaggaaagtgaacacagagatccagagtcagtgctattaaaggatactaggtcagggaatcagggtgtcactttgaaaactaaggagcctgttgtcaggactcttcaaggtaataattatagtttagtcttcctcccactcatgtagcatttggtagttgtattttcttttttaattttttgagacagagtctcactctgtcacccaggctggagtgcagtggcacaatctcagctcactgcagcctccgcctcctgggttcaagcgattctcccaaagtaatccccagtagctgagattacaggcatgcgccaacatgcctagctaatttttatatttt

SEQ ID NO: 8390 - DNA, 1404 bp, Homo sapiens
atcccagcactttgggaggctgaggcgggtgaatcacctggggtcaggaatttgagaccagcctggccaacatggagaagctccgtctctactaaaaatataaaaatcagctgggcatggtggcgcacacctgtaatcccagctccttgggaggctgaggcacaagaatggcttgaacccaggaggcagaggttgcagccagccgagatcgtgccactgcactccagcctgggcggtagagcgagactccatctcaaaaaagaaaaaaaaaaaagaaatgctgttttattccttttacatgtagttcacctaaagtaaagtagtctgcagttaccaagtagaagtgcattcatacctgttttagtaaatagtgtttgtgggctttttgccactcctttgaattagtgtattatataaccttacaatagctattttctctttttgattaaagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaagtaagtatgctttctgtctacagaaagtctcctaacactgtcagagacacttactaactaactcattcactcttgtttaccatctagctgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacaggtaggtagtaaaatcgtagtaccagaatgggtaatgtttttacaaatctcacaacataaccagatgttaactggaactgtatacagtcatgggctgcatgacaatgtttaagtaaacaatggaccacataaatgaatgacggtggtcccataaaattataatggagctaaaaagtcctgtgctaatgtcatagtgcaacacattactcacgtttgtggcaatgctggtataaacaaacctattgtgctgccaatcatataaaagtgtagcacatgcaattatgtatagaacataatacttgatactataataagttaatatgttactggtttatgaatttactatacttttaatcattattttaaagtgtataccttctacttttttttttttttttttaaagttaactgtaggccaggcatggtggctcacgcctgtaatcccagctgaggcgggcagatcacgaggtcaggagatcgagaccatcctggctaacgtggtgaaactccatctctactgaaaa

SEQ ID NO: 8391 - DNA, 2454 bp, Homo sapiens
cagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaattttattctgcttttctctaagctgactattttctacctgtagcttatttcactgtttcacttttacattctatatgtgctgccaatgaaaaattagtatttgaagag

SEQ ID NO: 8392 - DNA, 1632 bp, Homo sapiens
gcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaagacttgatcatttcatgaattccattccagatgttcaacttttcatcattttactccaacctcttacaaattttggaatttcggacctaaacttagaaatgagggaactattgattctcctaacttgctctaaagtttggcttgaagaaaaggttctggtatagcaatttgtatacgttgaggatgacctttagtttctccaatgttctatgtggagaaatactgaaaactcatagaatctaggttgccaagatagattcctcagctcttttatttattttttgagacagggtctccctctgtcacccgggctggagtgcagtggcagtgtctgctcactgcaacctccacc

SEQ ID NO: 8393 - DNA, 1524 bp, Homo sapiens
tttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcac

SEQ ID NO: 8394 - DNA, 1202 bp, Homo sapiens
acatattagagatgggaaaggaactcctactgtgtattagacagcagccaggtgctttatatatgcaaattcagccttcccaggaacatccctcaaaagatattgttatctctagttttacaaaatgaggaataaaactgtcttctagggcaagattttaaggtaaagtaagattacacagaggcagatatgaaactggaacttaggtcatatctaatgccaaagccccatttttctctttctaggcaaggcttagttaggagtcaggtactatggaacaggaagagaaattatggggtgtgtgtgtgtgtgtgtgtgtgtgtgtgtgtgtgtgtgtttcggtaaagtcaataaactgcatcaagtcagtaagtgtatttgaaagctacaaacacgggcatttttggttgcttttgggttatcccattcccactccctgctgatagcaggacgaaaagatagatgttacctttactaattttgtggtcttctgttaaaaggagaaaaggaaaatgcctggagttccaaatggaaatgtttgccacatagaacaggaaccacatgggggtcacagtgggccagaacttcagcgcactgggcggtaagtcctgggacgtttcacagcgatgctgcttattgggtagaagttatgcaaaggaatgaggcatcttctttctttcagcctacttctctgtggtgggaatttattggctgaagaatgacttttcaaatggaaccactgactagaagtattatgaatatatcaaatatcgtattcattcattcaagtttctcaaatcacctaccatgttttgtctcacctccagtccttcctaccattgttccctctgatttgaacactcttccctttcctcatctcctggctaactcctacgtacccttagtctcggttcttgtgtcacttcctttggaaagccttctaggactctctctggatgaggttaggtgttcctgctatgtaatatcacagtattgagctctgaccctcccttccccacattacagcctttatcatacttcattattattggttgatctattgtcttttctgctaggctgtttattccaaaagggcagaggctctattatattcctaggacccagcacagtgccctgaacagagtaggctctcaatgtctgccaaatgaatgaatatttttagaataatgtctgttctgtag

SEQ ID NO: 8395 - DNA, 1182 bp, Homo sapiens
agtgaattgactttttaaaatcattatttagtgtctctatccctggtaattttccttgctttgaagtctactttatctgatattaatataatcatcctacctttctgtcggttcatattttcatggcatttattttccactttttacttaaaagacatttttcccttgaaataatttcagatttatagaagtgttgcaaaaatagtaaagagagttcttgtattttcttcacccagcttcccctaatgttagcatcttatataacagtgatacatttgttaaaactaagacatttacattggtataatactttattaggtaagctacagacttcatttggatttcaccaaattttctactaatgtccttttttctgatccaggatccggtccaggataccatattgcatttaacattctatttttaacttacatttatcgtatttaatgtgggtttctggtagatagcatactgtatgttctttttttttttttttaaatccattctgacaacctctcttcttcttattcctttttgaaaaaattgtattgtggtaagaacattttacatgagatgtaccctcttaacaaattttaagtgtacaatacagtattgttaattatatgttcaatgttgtacaggagatctccagaatttattcatcttacttaactgaaagtttatgcccattgattagtaactgcccatgacaatctcttttagttggtatgtttagaccaccttcatttaatgtagttattaatatgtttgggtggtctgtcattttatttgttttctatttccttttccttcttttggattatttttaatattctattttttttttactgttttcattatatagttattttagtgtagcactaggaattacaatgtacatacttaagtgttcagtctacttagaattaatatattaccactttaagtggaatatagaaatgttagtaccaccaggtgcagtggtgcacacctataatccaaacactttgggaggccaaggtgggcagatcgcttgagcccaggaatttgagactagcctgagcaacatggtaaaaccctatccctacaaaaaatacaaaaattagtgggcgtggtggctcatgcctgtggtcccagcttctctggaggctggggtgaaggattacttgagcctgggagttt

SEQ ID NO: 8396 - DNA, 1192 bp, Homo sapiens
tatttgtctttcttcaactggcgtattttacttagcataatgtcttcaagggtgatcgatgttgtagcatgtgtcatgatttccttcctttttgaggctgaataatattccgttgtgtgcatataccacattttgtttccattcatctgtcagtggacactttaggttacttccatctttggctattgtgaatgatgttgctgtggcattttgtttcattttcattgtaaaatgattttaaaaatgatgcttcttccacagcattctggcgtctgtccggaaaggctccttgtagagtgctgggcactggctcatgacaagtgacacttcctctcctcacctttttgatgccagttcattgcacttttgcttcttttatatctccctcctagtataagtaatcaaacccaagcagagactaatgaattttttttcctgccaattcaagtccattctaggactgacaatttccaatcaatgttctctgaactgtttgtttcaagacttgtcaatctttggaaatttgagtttgttctaatactgccttatatgttcagattctctttaatggctctgagagtccttcactacatctcattgtcacacttttctctaaaataatttgttacaaagccttgctaatggcagcttgctgtgcccagggtcctgaggtcccatcatcaagcgttttgattcatctgccattcaaaagactattgatatcccgagggcaagttttagatacacttggtgaatttcattgctttgttcctttgacttcttcctttaaacacccaggctccctccctctgtgggaaggcgtatttttggctggcccttttctatctgtgccatctgtcacaggggtcattgctcagaggctggcttcctccctgctgggagcaggtggtcaaaaccaatggctattgacagggtcaggttggggcagcttaccaatatgccccccaagcagtatgcatagttgttctccttcagaggaacaagagaaaaccttacttgggggtctttttctgcattaaagaggaaaagatgcagatgtgattctaagttgtttatttattcttgtggtccagccacttgtcaactgtcctgtctgtgctcttgtctctgcgtacttcaactggcactgtactttaagaccactacctgaagcagcctccagtgtagcaag

SEQ ID NO: 8397 - DNA, 1114 bp, Homo sapiens
tggaggtctttaatcttggctgcagaactgccagtgtaaccctgggcaaattcttgtgtacgggtctcaatttcctcatctatcaaattttgttttccaataattcttccaactgttattctaatgataaaagttatagaagattgacatggaaatgacagacctgaggataattcattttggactgttctggaaggaaagaatgagaattataaggaaaagtgtggattcagttgtccagactcacccaagttcttgtggccatggaggggtcctggttgtagttaaaagtcagaaggttattttagttaaaagtgagagatagaaggatgtatttaaaagatagagatagaactcacttaagcgagttctcatggagccacagttcttgggaactgcaagtcagccatggtacttattgaacgttttcattgttgttaatgtcgtgacgcatcagattctcaaacaaatggttttttgtcaaccaggagtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcatttgagtcaagttgaaataggcagctggtgttacccacttcctctacctggggggcccaatctgtgtctgcagtgctaggggctttattctaacactctggaacctctgttttctttctttttttttttttttttttttttttttttttttttttttggttaccttttttgtttttgtttttctcttctgtttctgtgtaggtctctttagtcagccttatagctaatgccctgggctactcggaactaggtgccataaagtcccttaggaccctaaga

SEQ ID NO: 8398 - DNA, 2805 bp, Homo sapiens
agatccggcatgggctggcacccggggccttaagaactcctgctctcttgccacaacgcttttgtctcctcgctatctgaatggcaccctccttctccctcactctctccatcccattctctgcattctcttggttttctctcccttttgctttgtcgctgacacccctgcccaccccatgctggccctgtttctctcctgcccctccctccccagctctccatccctcaccctctgtgcttctgtctccatccctggctctccagcgtccctggccttttggtccctgagctttaatgcctttccctgccttctgttcttatttggactgcagtggccctttgcaggagctctggaggcccaggggctgaggaggagggttacccctctacccatctgaaacctagggtctagggggatcaaggaaaaaaagtccccaaagaaggggaattttttgtttgtttttgaggggagatcccagaaatgtagcttgtttcatattttagtcttcttatttttgtaaaatgtgtagaatttgctgtttttctttttcttttgacaactcaggaagaaactgacctcagaaagaatgttagactttggctgctctcctgtgtgcccctcacacctgccccctcccccccactccatccaggggaccaaattctcccagacactcaaaaaatgagacttacggggaaggggagaggaagacccagaggcctcagtgaaaccccagctattcctggtcagaagcagaatgtattcctaagggcttcctccccagggccgaggcctaggcatgaatgtggggagtgggctgtggggtttgagagaagggaggccttattcctctcctgctgctccccaccccctgccccacccaacccctccgctgagtgttttctgtgaagggctatccagagttaggatgcccttgcccaattccttcctgagacccagaaggtagggtgggagggcccaaatgggaaggtgacctaagcagaaagtctccagaaaggtcatgtcccctggccctgccttggcagaggtccccagtgacttatgctaggaggattccatctgggtagacagtctggccacaaaatcagctactggacctcagccatctctgctggaggctctgaggaggagtgagcatccctcacttgtgggggctctgtgaggaaatgtgccttccccattcccccggagtcctaggtctggagctccagggctgggagagggtgagggagatgggcaggggtgttttctctgaccttgggggcttagtctcagtcctgcctgaactttccactaggcttggaacccttccaagaaccatatttctctccttcccaccaattttcccttgatgaggctttagcagtttgctcccaccacccccagcccatttcacaactctgatcttagtccaaagcaggggacacgcccccccaccaccactttttctctctcccatctcagcctcctgtgcagttccttgcctgcccgtgcatttcctagagtctactgcctcccccctggctgggagggtgtctgggggggatctttcaggggccctggcacccagggcctgtgctggcctaggagtgctgaccagaaggctgctctgttcccccccacccccgttgctttctggccccctctttggagccagccacccacagggctttggtgcctcagaagcagtgggctgccgggtcacagccgcaggctgcaaaagaccctcggagggagcatggagtgaggggttctctctcaggtgtgtatgtattggggggtgggggtgggtggagggtgtcagggaagttggggtgggatcccagccttcccttcaagaggcagggagctctgggaggtggagtccccaccgctttctctactaggctcctcctgttccccaggcttggggagctttgcacaaggagactgcccccagcctagtggcacctacctcatgggctctggggcaggtaggggaagggccagtccagctctggtaatgctggggggaggcataccaaagaatccaggggcagggagtggggagggtgacttccgagctggcctctccccttcctctacccagactggggctgggatcctctcctcccgctgtaaccatttctacctcattttgctgcgtgttgtacatggacgtatttatctcctgtctgacgatgctctgcagttgtggtctgtctacctcagaagagactgtattttaaaagaaagtattacacagtattaaagcgatgacatgtggtttgcagaagatttctcgggggcagtgggatgtgggagtcctctgggagatgtctggacacctgtgtatgctggtgccctgggcggggtgttcctaatcccctagtaacaaggagcaaggactcctgtgactcactgtgatacagtgagtacctacaggaatgggcactgaggctatggggaagaagccatgggtaaggggccttcctgccgttctgagctctgacattcagcactggggcaggctcattgtatccccagagccacaaaataggggggcaaggaagggctcacatgtttgttgaatgagtgaagaaatgaatgcatggaggaagggggttgctgaagagagggaggagccatccagaacctgcagcagccttcattgaatagagctagggttatacttgtattccattctcagtggagataaagtggatagagggcggggtgtggagacggccaagttccaatgtctcaggtgacgtggtgtcctttgtctaccatccccccatc

SEQ ID NO: 8399 - DNA, 1126 bp, Homo sapiens
atgagacaggtgctgtgtttgggctgtgttcagagggtcgctgggacacaggaggccctccaaggctttcctgtttggtggtggtagatccagctcattgtggttctcccgtgcagatgagcaagtcttggtcaggatcaaagcagtgctgcacacaaagctggtgatagctgttaccttccccaggcatatgcctcctctttcctgagtacctcacatttcaaatttgacataatgttcagaatcctacagttcacctaaaggaaatcaggagcagtcctaagaaagaaatggtgttcccctgtccttactgaggtcccaaactggtagaccactataaatgaaaggatgctagatggggcttcagggggcatggaggtgggaaatgtgaattcaggagtctaacctgattttgtgttgtatacactcatccttaccaaccttcactgttttgctgatagttacactttttctgggactcatctgtggttctctgcagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaaggtgagtggactagcgcaggagcggcgaagtggtgtaggcatgaaaggtccgcagtgtcctgatttagttcctagaattcctttttactgaggaagttggggctggacctcaggaactctagtttaatttaaaggaaaggaggtttgagcttcacttaagtgaggtatctacagggtgttcccttcacctctgtcttgatagaactccctcaggaaccctataatatcaatattcagctacttgtcaatcagtggcttgacatagtcatttgttacgaaggagtaatcatcttagaatcccacaatagacatgagaaaaaatggaactaaaaagataaaccagtgtactgggaacatcagtttagtgatttccatgttcattgatggggacagctggcttaaaggccacttggtggattagattctgggccttactaatctgggaaggttttcctggagg

SEQ ID NO: 8400 - DNA, 3592 bp, Homo sapiens
aagggagccttgcagagcatttccctaaggtcggccgccgggtggatgtggatctgccagactgcactgagcgggaggtggcagggaaatgagtgagagcctagggaccagaaaggcttctccagggcatgaccgagctgatggctcctgggtctctgcacaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagagctgctctggtgccatctgtcccacatacgtagtacggccacccagcttttgtcaggggagttgggaatggggtggatgttctaaggtcagggtctcgtgctcacaccagctgtagcagaccccagcaagaggaatgctgttcccaacatcctgggtcttcctgagactgttgctttgtgttcctagagggcgggtctggcatgcaagggacagaagacacaaagcatccttttcttgggctttgtctgaatttgtcttctcacgttttttcctgtttacaaaagagggtcatgttcctagttagtcacactctctcatgtcttagaggcatgag

SEQ ID NO: 8401 - DNA, 1176 bp, Homo sapiens
cagcaggcggctggccttagttcagtctcctagggtgcccaactgggcgcacggtgctctgaacttgggtgggtgtggatgggggtcacagcaccgtgggggaacaggtacacagagctttggcgctgctgggatccgtacgattctaactgggattggatttccaaaaggccctccttcctcccagcctgtcagctccctcccagtgtcccggttgttttcttaacactttagaggctgtggctgagttggcaggggttccccaccctgaactttctgtctgaggtgcgttaggaagcctccggatcattgaaggaagtgactggcttggtggctgacctgtggagggctgcttgctgtgtattgaataaaggaggcttcttggggtcggggcagggtctctgtaagcacagggagaattgatttcgctggggcttggatcacgtgtgtgtgtgtgtgtgtgtgtgtgtgtgtgtgtgtgagagagagagagagagagagagaaagagagacagaggtggaaacccttgtccttggggatcctggatagaagttgccagtgttggagtcttggggcggtgctgcctagaggatacctcccaaccattccagctccagatgctgatcatccctatgccccctcccccagtagtctctgttggatcttacaggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatgtaggtccatatcttgtgttgttaagaacctgcatgaagggggagggactgatgggggttgatccggatgtgggacgtccaggtggagaaacaggatttgaataaggcaggaacaagcgcccagttctgcccaactgctgtctttcctccttcacccccagcccatccctggccaggctgtcctagtgcaggcagatgtggccaccctcacctctcgcagggtgctgcatgcctgtggactggtgccactgggtgtgtggggcctgagctacaagggtctctgttgtcttggttgtcaggctaggggtggaggtgccctgttcagggcctgtggagttagaaggaaggctaggac

SEQ ID NO: 8402 - DNA, 1312 bp, Homo sapiens
aagcaggccctcacaggtgggaactcagaggccttggcttgctcattcgttcccttcttcccaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgagccatctctcccttgtcttgtgtctgcccgacgtgttaacactttctggcattcctgtgaggacacaggtgtgtgttgagggcattgctccaagatgaggggggtgggtgggtgggattaaaggtgtatgaaaatggacagattttgtacttggctggatattcacacaaaacaggtgttacccagatgtggctatagccagtctcgtgaaggaaggtgcattgtagggtgagggtctgttgcttttggatgtgactgagctgttcctcccttttcccccccagcaatcgactccctatttcaacacctccaaactcactttgctttttttttttttttgtaaacttttgcagattattttatcactcaggtattaagcctagtacccattagttatttttctgatcctctccctcttcccatcctccaaaaagctccagtgtgcattgttccccgctgtgtgtccttgtgttctcatcatgtagctcccacttataagtgagaacatgtatttggttttctgttcctgtgttatctc

SEQ ID NO: 8403 - DNA, 1127 bp, Homo sapiens
aacttcaaactcaccactaggaatacaagagttgtcagtagtggttaaatatacctggagtaagagggacccaggtttgaatcctagctttaccgtctgtgaccttgggcaaattactgtctgaaatctgagtttgcttttctgtagaatgggggacaacctcacaggactgttaaaaagataagatgggatataatgaatataaagtagctggcacacagtaatattccataaagagttgtatttatggaataatatttctttgcttacataaagattaaggtgtcataattaatctcagaagcttctcttcgtaaagtgcccttattactgaacccccactttttttggtctggttttcttgtatagcatgtttaatatttggcaattaacatgggtcctcttgttctatgacagtagtgagagaagtttcttctaatttcttacattcattcctctatcctagtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatgtaagtgtaaaagttgtaataattaactagatattgaggataatgtctaaaaaagactaattgtggaatgggcagttgctgttgaaaaaacaactagaaatataatttaaggccgggaatggtggctcacgcctgtaatcccagcactctgggagtctgaggcgggtggatcatttgaggtcaggaattcgagtccagcctggctaacgtggtgagaccctgtctctactaagaatacaaaaattagctgggcgtggtggtacacgtctgtaatcccagctacttgggaggctgaggtaggagaattgcttgaacctggaagacggaggttgtggtgagccgagattgcgccattgcactccagcctgggcaacaagagtgaaacaccatctcaaagaaaaaaaataaaatcaaaattatatatatatatattttttttttttctttttttt

SEQ ID NO: 8404 - DNA, 1105 bp, Homo sapiens
gcaatgtttgaagacattgtagttgtcacaattggagggagtgctgctgacataagtagaatccaggggttaattctatagggaataggacagtccccatcaacaaagaattatgcagcccaaaatgcatgtcaagattgagaagactgattgatctagatgaacattaaatagatgataaatagattagctgcctaacagcacgttggtcacaaaggggacctaatttgtatatgtttcagggactcctggcccatacagaatttgagatagctaagcattaaaccaataggaaaaaacgggaggaaaagagccacctggggttgaattggagcatgtacttatggggcctgaggtaactgggatgacagtgtgacgtgaaagtgaaaaatagggtaaaatgggggttttctatgtgtgagaaatattgggcaaagtttttatgagataacttacggtttttgttttaatgtatctgtagacagggatgatcgttcttttggccgtgatagaaatcgggattctgacaaaacagatacagactggagggctcgtcctgctacagacagctttgatgactacccacctagaagaggtgatgatagctttggagacagtaagtttgtttttatgaagttagcttcctctgtgctttgggaggctatttagtaataggacaaatgtgttacagatgatcagatcacattaacagatagaaggaggaaagcagattaagaaaaattttggatagtatctgaaagaactgatagatgcaggaaacgaatttgataaattaataattttttttgaaaacttaaccaaacaaagggacagacatttctctttttttggagacaattgtttataaagaaacccaaactgggcatggtggctataatcccaacgctttgggaggtcaaggcaggtggattgcttaaggccaggagtttgagagcagcctgggcgacaaaacaagaccctgtctaccaaaaagaaaaagaaaaagctgacgtggtggtacgcacctgcagtcctagctgttcagcaagctgaggcaagaggactccttgagcccaggaggtctagactgggtgacagagcgaga

SEQ ID NO: 8405 - DNA, 1263 bp, Homo sapiens
ttttgtttttgcatgtaaacctcttctccttctggaaattcattatggaatatttagggattttttaatttccaacccacccttcccaaattattagctgagcaacaattatttcaccagggaaactttttgaagaaatcagatagaaaatttaaataaacagattcttccaaattggactgatagcttaccgtgtttctattaatggtgtcagagaaaaggggatggtgttacttgtctgtttcctctagagtatcgagatcgttatgattcagaccggtatcgggatgggtatcgggatgggtatcgggatggcccacgccgggatatggatcgatatggtggccgggatcgctatgatgaccgaggcagcagagactatgatagaggtaattgtaaaacatgtcgaattgctctttcagtaactttgccttttttttttccccctccgctgtgatgattataatttgggatatatttacaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtaatagttttctttttacgtacttcatggagcagaaactgggaaaactacggaaaatttgtgattgtgttacgaactactgagttgggcacaaatataatttgcacattgtacaggaagcagcaaagcatagtagaaagagcattggctggccaggtgtgggcagatcacaaggtcaggagatcgagaccatcctggctaatggtgaaaccccgtctctaccaggtgtggtggcagacacctgtagtcccagctactagggaggctgagagagaagaatggtgggaacccgggaggcagagcttgcagtgagtggagatggcgccgctgcactccagcctgggtgacagagtgagactccccatctcaaaaaaaaaaaaaaagcattggctaaggatgacatcagtggaaacacagcagtcgaattgttttcatctcatatgccttcacagatagatttttcagttaaaatttattgaataaacagtagaaatggaaaaaaaagttgccagatactgttatgttgtgatctcagtaaattacacttaaaacagatggttttagctccattttccaagtaagggaaatgaaattcagattaaaca

SEQ ID NO: 8406 - DNA, 1070 bp, Homo sapiens
atcatagtccatgtgtgttgagttttaagctgaagttgagcagtggttactagagtttggggtttcattgtaggtcctcttcacatatgtatattctccaggtcaagacacttttaacattgagaatgcagaaaggctgtaaaggatactcattcctaaaaaggtcacatggctgggtgtcccttaagttgtatacatggtcattattttttctatttctctgtgcatcagtaagacattgttctggaaatacttgtaaaccactggtttagggataaatccatctttgggagccaaaacttggatgtggaccattttccacactgttgagatcctggtagatgcgtgagcatctgcagcctgataatttgatattttcactctggcttcacagatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaaggtgagtcagtttggaaacagtagttggttaactgcagattctaaaatactgtgatgtaatgatggaagatctcctacgggatgccagcgttgtatagcaccttataagttatgctggctttagtctcttagtgtgctggaactggctcataagacctagttgttccattttctggagttccaccactttgatagcttgaaatcagctatgatgggagtactaatgccgcacaaatctgcaaatactgtaagtcagaggcttcccttttgccacatattggcagtatggtagggggtaacttcctttcatttctcttaagtcttctcatttgtaagcaaaatagcaacactattagcctggcgtggtggcaggtacctgtaatcccagctactcgggaggctgaggcaggagaattgcttgaacctgagagcggaggttgcagtgagccgagatgtgccattg

SEQ ID NO: 8407 - DNA, 2789 bp, Homo sapiens
ttcattctaagaaaaattcttagaattctaagtattcttactaagaattaaaaattcttagtattctaaactttttgccgttggacttctttccatttggaatacaaagtgtttggaaataagacattggtctttactgaaatagcgaaagaagtttagctttttcctggtttctgtcttcctttgttctcatcccttctgcaaggtgtagaggtggtatgagactatagtaagatcgcatgtgcctctgaccctcttccctagctcctctccaatggacaatgctgatgagcaagcaagtgggtgtcatctgactgtcatcccccattgccaaaggatcagtatcctgtgtcttgggttttgatgtgataattcagggccttcattatcctgtcactctcgttgtgttacagaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttcattgtaatgctgaagttctttgacaaatactctgcactcccagtggtttttactgtagtcattgaccacctgctcctcctcctcctaccatctctgaagttttcattcagtattggataccatattgtccaagattagagggtggggttacaagggaatctatttcagtgtttattgaggcccaataatagagtttgcatcctagctcccctctggcttttttttttttttttttttttttttttgcctggtgttaaattttttaatcacctggatgtgcctgcagtctatttcctgtactgtttatttt

SEQ ID NO: 8408 - DNA, 1205 bp, Homo sapiens
ggcctgtggagctccagcatcctcagggaagaggccacagcctgcttgctccattcttctccccacctcctccccaggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatct

SEQ ID NO: 8409 - DNA, 2275 bp, Homo sapiens
tgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccg

SEQ ID NO: 8410 - DNA, 2065 bp, Homo sapiens
ctcgctgaagagacagcctgaaagaatgggatgaatgggcagcaagcctggtagagaaggccaggtagaggttccaggcagaggagtggcacccaggaagcctagtgagaagaggatgagctggggacggagaggtggtgggcctgtgctgggcgccccctaggggagtcaggggcagttgagaaaggttagggagatggccttaagggccatgtgcctctgtcctcctgagcctctctctttctctctccattgtaggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcatgagatgtggctccctttaggaggtggtagggaaatgaccagctgacctggtgagggagctgagtgaggagggaaagcttgtaattgattggactttgcagctttcttggtagaagaaaacaggatgaagtgtgcctggattgtggtggggacaggatgggggaaagggagcccatggggactcaccctgagtgaccgggtttcccacaaccaccaggtgtgggttcagaatctcactctgtcgcccatgctggagtgcagtggtgtgatctcggcttactgtaacctccacttcccaggttcaagcaattctcttgcctcagcctcccgagtagctgcaattacaggggtgcaccaccacgcccagctaattttttttatttttagtagagacaggtttcgccatgttggccaggctggtctcgaactcctgacctcaggtgatccgcctgccttggactcccaaagtgctgggattacaggcgtgagccactgcgtctagcttggtgtgg

SEQ ID NO: 8411 - DNA, 1177 bp, Homo sapiens
tttgcaaattcttggtgcctgataagataaatgcatgcacggatgtgtgtctaagcaagcgcgcgcgccgcggagcgagtgtacgtatgtgtatgtgtgcgctccactctcagctttgctcatctcggtgcccggcccccttcgctctccaagccccaccccccacccctccaggcttcgcttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatgtaggtaccggagtccggggctggggtgtagggtgcaggagagggtgggatttactctttccgtgtgtaaagagtggaactgaggtgcaaggaggagcttctggccctttctatgtaaggtactggccctttaaacgtgggggcctcagcgtctcctttgcgtgtgtgcagtagtgtttggagtgtgtgtggtttttatggtgggtgtttagctcgaacctgtggttgatgccactccagagttcctggggatagggagagaccgaggtgtgtgggtagtttgcgccttcacgtccgtggccctggaaggatatgacactcaggaccgtgggtggcgtttgtaaagcccatgtgggaagctggcagtgttaaaaatatcgtttgcagagcgtgtgaatccctggagtgtgcagcgccttgcctaggtggtgtgggtgtgggagcaagggtctctccaccagtgtcgcctgcgacagctgccaggtccacatggcctgtgaggggatgtttgtggcgtgaggccgggagggcgtgtgcccctgcgtggctgcgggggcggttttg

SEQ ID NO: 8412 - DNA, 1241 bp, Homo sapiens
gagattgtgctactgtactccagcctgggctacagagcaagactccatctcacatctgaatattttcaaagatcccccaggtggtcctttgagcaaggagagtgagaacctgggttcttggttttttggttttttttttttttttttttttttttttttggagactgagtcttgctcttgctttgtcacccaggctggagtgcagtggcacgatctcggctcactgcaacctccacctcctgggttcaagcaattctctgcctcagcctcctgagtagctgggattataggcatgcgccaccatgcctggctaatttttgtatttttagtagagacgggggtttcatcatcttggccgggctggtcttgaactcctgacctcatgatccacccgcctcggcctcccaaagtgctgggattaccggcgcaagccaccgcgctgggcaagaaccagtgttcttaagcaagaatacctgtgaactgatgcattggcgggattggcaagcaagatgagtcatagaggggcttgggtttcatcttaactgagatgataagcctctaaaggatttaagtggaggcatgacagcagacaggcattttggatttccctgacttcgctgtgatgaatggagtgcaggagaaaagaccgggtaatcaggctgctatagtattctaggcagggaagggtgggctgaactgaagcagctgcacgagggatggaatgcagtggatcggtgcgagaagccaaggattaacctggtaggtgactggcgggagggagagcgagagaagggaacatcagagatggccccacatttcttactcaggagaaggcagtgccatttgctgagaaggattacaggagaagcaggttttcaagggtgtggatgatgaacataggggtggagtggattgcagcctctgagttgaaggcactcagagtatttcattcttaggtgtctcctgccttgggtgggtgtggctcaggaggcccacctgccaaccccgccccctcatgtggtgtatgtacctattgcatgcatatccccttccaccatacacactcactggttcctctccagtttggtctgttccctttctctggtcagttgcacaggtgcttccggctacaagtagagagtttgaagaaactgggtaaacaggcccagggctgcaagatggtgattttgtggctggcagccctgcaaccctgtagccctgaacacatggctgagccagtc

SEQ ID NO: 8413 - DNA, 1138 bp, Homo sapiens
cccttcccagggcgctatggcagatactcatagtaggcccagcttaagcacatcttctccctgcagctctgctctggatgctatccgggaagccctgcagcttctggactctgtgaggcctgaggcccaggccagagatcagcttctggacgataaagcacaggccttgctgtggctttacatctgtactctggaagccaaaatgcaggaagtgagtgtggctgctgtggggctcaccagaactgggtgtaggaattactgtccctgggcccccaacaagttggtatcagcccttttttttgttcgttatttttagagatggggtctctctgttgcccaggctggtcttgaactcctgggctccaacaatcctcccacctcagcctgccgagtagccaggacgataggcccacaccactgtgccctgttttataccccgatcttcccatccagggtatcgagcgggatcggagagcccaggcccctggtaacttggaggaatttgaagtcaatgacctgaactatgaagataaactccaggaagatcgtttcctatacagtaacattgccttcaacctggctgcagatgctggtgaggggtaaatggagtgtggcatgggcatctccatggcttcctaagagtggaacagggacccctggtgagggaaaccctgaccttgtagggtaggaggttgtggaagcagtgggaggttggcgtaaagggcagaggatgttatggaggaagggaagttctctccagatggcccatgctgagacagcagtcattttcttctggcttaacagctcagtccaaatgcctggaccaagccctggccctgtggaaggagctgcttacaaaggggcaggccccagctgtacggtgtctccagcagacagcagcctcactgcagatcctagcagccctctaccagctggtggcaaaggtaatggggtggggcattgagggggacccatataaacaaggactagaccagaaacagctccctcgccttctttggcctgtgatcctcctgagaagccatgaaagccagtgatggaagcgcagggctgtatcaccagtcttattttaaatccaagctccctcattcattagtgtatggccttgggcaagttgctt

SEQ ID NO: 8414 - DNA, 1184 bp, Homo sapiens
ggcaaggcaggagggctgtttgggagcacaggatgtgttctgaggagtgttagataactggagagaaaaggttggaaccttgaagtaatgtcatagattattaatcctggatagatggatggccaggctggatggcctgtgggcagagagctgtgttctggggtagggcctgatatcgccccaggggcagtaccttctaggttactggttaggttttgcctcatggcctatctcgtgaaagcactctttcaccctggcctgagaccttgcagattacctcttctctgttgacctgctcgtggtgacttggtcgtttttccccttcgctgtttttttcttttaactttcacaatccttattcctttttcacaacctggatttgagcccagagtgggccatcaggataggaggttttagcaggaggcaaagaaatagaattttggggatggcttcttgtcatcttctgactccacatcctctgtgttcccctccagaccctcttctggctgtgcccaagtgctgtctcaccctgggcatacacctgttaccagcttggcctgggcccccagtggggggcggctgctctcagcttcacccgtggatgctgctatccgggtgagtgggtccctgcccctcatgcacatttcagtcctggcaaaagtgttcctcactcggttgtggaaacatcttgggggaaggaggagggaccttggtccattcagtcttaaacttacccagagaggagctttgccatcagactcgtgaggtttaaaattccgctgtctgtaattgtcagcatgaacccgtgcctcatgtttcacagtccctctcccgcttcctctcgtttctggctctttgtacattagagaggccagcccactgtgagatgatggggtgcttgagttttcccttatctcctgccccactctcctaggtatgggatgtctcaacagagacctgtgtcccccttccctggttccgaggaggtggggtgaccaacctgctctggtccccagacggcagcaaaatcctggctaccactccttcagctgtctttcggtgagtgggacaaggatggagggagggcaaggacctagagaaaggcacttagctcctggaagctctgtcaagggaggtaggtccaacttttagaacttagaggtcctgagctgtaatttgctttt

SEQ ID NO: 8415 - DNA, 1159 bp, Homo sapiens
tgagacagagtcttgctctgtcacccaggctggagtacaatggtgcagtctcgctaactgcaacctccgcctcccgggttcaagcaattctcctggctcagccttccaaggagctgggattacaggcatgcgtaccattcccagctaattttgtatttttagtagagacgggatttctccgtattggtcagactggtcttgaactcctgacctcaggtgatccgcccacctcggcctcccaaagtgatggaattacaggcgtgaaccactgcgcccagccactcttggtattttcaatgatgattcttgagatttcagtgagtcttcaggtgtcagtgaatggaatggctaaacataaaaaggcttcaaaacttgtgatactgtgaatgtaggatgtcagttcaaaagaaatgatgttgtgactgtagggtatcactgagatgccagtgataacctgcccatgtcacatgttgacccttttctctcttaatttcaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggtgagttgacccagccagtttcttacaaatataaagaaaaattaatagatttggagataagaggaagaagattaattttttttttttttgagaccgagtctgactctgttgcccaggctggagtgcagtggcgcaatcttggctcactgcaaactccacctcctgggttcacgccattctcctgcctcagcctcccgagtagctgggactacaggcacctgtcaccacacccagctatctttttttatttttagtagagacagggtttcactgtgttacccaggatggtctcgatctcctgacctcgtgatctgcccgcctcggcctcctaaagtgctgggattaccagcgtgagccaccatgcccggcaaaggttaatttttttttttaggatttaagactcagagctggatgcatataatcccagcactttgggaggccaagataggaggatcacttcagcccaggagtttgagaccagcctcagcaagaaa

SEQ ID NO: 8416 - DNA, 1084 bp, Homo sapiens
atctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatcca

SEQ ID NO: 8417 - DNA, 1975 bp, Homo sapiens
ttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcc

SEQ ID NO: 8418 - DNA, 1172 bp, Homo sapiens
tggatctgatgctatcttctttcccctttcccctttccccttgcagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcagctcacctgtgctatcaccttggctgggcatggcacattctactacttttgctaaccttccacagaccctttaaagtgtatcagtttcatagaagggaaccagagcatcagtgagaaagacactgtatgattcccatgttttttaagtgggaggactcttcaaaattggctcaggcagagtggcatgaatctttattgtcttcccttgggtgaatggatataggcctttagcttatatgttttcatatctgctacagagattcttaaccctggctgcccatcagctgtgagagagtaatttggggctttgccccaaatctactgaataatacttatttttatttttttttaaattttttcctaaaactttttatttttatttatgtatttacttattttgagatggagtttcgctcttattgcccaggttggagtgcaatggcgcaatcataacctccacccaccaggttcaagcgattctcctgcgtcagcctctcaagta

SEQ ID NO: 8419 - DNA, 1205 bp, Homo sapiens
ggcgatggccggcttgctggccgggcgggtgagcgcggctccccgcgggggtcaggcgctggcgcagccacacggggaggcgctattagtccggcccctccccctgtatcgcagcgcccccccccgaccgaaccgtttattttttcccccctctttctagtcgagggaagggggggctttttttcttaagtggaaaatgcttggataaccgaggggagagggggctgcggagttaaagaaagggtagacgggctcccagttgccgagttaatcaggacgtttctcggggtaacgaatttttaaattacaaaatgcctgccgatgtaatcccagaccgagctatttatggaaggggtattggacagcagtgttagcagctggattgctggaatggggtacctttatcttgacctagtcaggagggaaattcgacaaatttcttggattacttggtttggagttagaaatgcatctttgtactttacctcaagaaatggcttcaaataggtttcctgttttgttttttttttttttgccttttcgaagttgcgttattgtgatatttgtaaagggcttcctattacatctgcaagagggtaaggaattaaactaccaggtctttaccacatcttattaaaaaaagaaagtcattcttacagacctaacgcttcttcccccaccaagcactatttttccatgagtgaaaagtgttgaattctgggattttgccagcaattaattgtattctgaaaatggggaaatgatgtgctttggggatgcacttatataatcacttacattcttggagtagccagaggacagtttgccatatacagaatggtgtgacagacacttaagcacctaagatatttagggtatgggctttgtgttagaggaaagttaacacagtggctggttttgtgaaggaggaaatctagctgtgggaggagagagatgacatgttgagttttaaaaggatggatacttaaaatgtcattggggacattctacaacttgggagaggtcctttctaaagctgttacgattaggtgctaaaggaggtattgaaggcaaaggcatatccaaaaaaacaaattttctttctacacataactagttactctaaagcagaaatgttaggaacaatgttaggaattgtttcataggtgggaaaagggccatcttgtataggaaaggtgcatttg

SEQ ID NO: 8420 - DNA, 1109 bp, Homo sapiens
atttcacttcaacttcaattaccatttagtaattctggattgaagtagcagttggagctcatgcttgacttttcctttacagaaaggagaatcagttaagaagatgcgcgaggaggtaagttatgaaagactgagattgttaactttgggaagtaaaaaacctttaaaacaagtgaaaattctttttcagaaattaggaaggtctcaataagggaaatatgtattttttttcggcttggttatttgtagtgataatctggggagtgtattttttttttcccctttttgggaagtgtggttttgacaagtcagaattctttcaagacttaaggcagctgctgtaggctatctttgaggatagtcatggagcagtagtgtttggaatgatgctgactttgctttgcatcaggatcatgtacattggcagtcttataagggactgtagatcctgtacatactcagatcttctttgttttaacttcttttggatcttgtttcctatctagagtggtgcacgtatcaacatctcagaagggaattgtcctgagagaattatcactttggctggacccactaatgccatcttcaaagcctttgctatgatcattgacaaactggaagaggtttgttgtctcccactccctcattcttcatttttaagtgcttccagagagcttgttgattttctaagagctttttaaattcaaggacacactggaccttgagactcgctgtaaatgggtccttagcttcctgtagcctcccacaaaattcgagcatttgtagtttaaaaaagagtcacttgaggctgggcgtggtggctcatggctgtagtcccagcacttttgggaggctgaggcgggcagataaacgaggtcaggagttcgagaccaacatagtgaaacctcgtctctactaaaaatacaagaattagctgggcatggtggtgtgcgcctgtaatcccagctactcaggaggctgagataggagaaacgcttgaacccgggaggcggaggttgtggtgagccgagatcacaccactgcactccagcctgggcaacagagtgagactctgtctcaaaaaaaaaaaaaagtcacttgaatcatca

SEQ ID NO: 8421 - DNA, 1127 bp, Homo sapiens
gcttagctaatttttgtatttttagtggagacggggtctcactatgttggccaggctggtcttgaactccctgacctgaaatgattcacctgcttcagcttcccaaagtgctgggattacaagcttgagctaccgtgcctggcagtatttgatttaattttgacatcatcttttttccccattgcctggccaagtgtaactgcaaaacagattattacttttatccttagcaagtacattccttcagggtgaaggaaaatatatttatggctaattttgaggaatttttcatgagcttttatctttacatcaaaaatagtttgagaggggcatggtatttgaaccttttgtctatggtggattatgacctcgcatgtcctaataagatcacttaccctaataagggtaagtggttctttaatggcagttactagtttccagggatctgcttattgtggtgttctttctttctgtaggacataagcagctctatgaccaatagcacagctgccagtagacccccggtcaccctgaggctggtggtccctgctagtcagtgtggctctctcattggaaaaggtggatgcaagatcaaggaaatacgagaggttagtgacttttgtcgtccttttagaaatgttaactatttgttccaaattggctctttgtatggctaggaaaagttagcaatgagatgaagatttttattgaagtaacagttctagaggattacaatgtgattgtactgaaaataaaactcatgcaatagaattattttgcataattcataaattttaataaatcagaacatgagaatgttaatcagaattttcaactattacatatgacaagtttctatttttttttggcaacttttccatgaggctacatagttctttttcatgtctcaagggatgagtttgctatagtagcaacggtttttctattttttaatttttaactttttttcttttttttgacacggtctcactctgtctccccaggctggagtgcagtggcgcagtcatggctcactgcagcaaaacatcgaccttcccagcctcaggcgatcctctcatctcagcctcccaaggagccgggactgcaggctcccaccaccacaccca

SEQ ID NO: 8422 - DNA, 1204 bp, Homo sapiens
gttatatgcaagtactataccattttatgtaaaagacttgaatatccatggatatttgtttctatggggggaatcctaggactaatctcccaccaataacgtagggacacctagggacaactgcattgggattcaggttgaaatagtgactgattttggtagctgcctaagcaagtgcgttgctcaaaacaccttttcccacttggggctggtctgttacaagcatatttagttaactagttccatcttacctgcgtttgatctgggagccatttagagggcaagcataaacttgggagtccatctctttcacattgtgttgaattggcataaaaatgaacaagtttttagaggtttagtttgtcgtgtagttatgagaggtttcacaggaaggtcggttatgtcacagtgttaaccttgagtcagtttagtaccttgcttttagaaaagtacaaactggtttgttcaaagggctctcagtctagttagtcagagttgggcaggataagcaaaggcccagagtcagtgtcgccagaaggatttagccttaggagtttttctttcccaggaactccaggttcctgctcttctggattctcccactccccctttggaatagagtcccatactgggtggcagcaatcctctgtacttaaaattcttccttcacttccttttttttccactccccatcacacctcccccttcatacctctttgcttccctacccaccctccctccctccctcccctttatttagttgatgaccaccgtctaaaaatttgcagcttcttctatgagtggccctgtcatggattgttcccacaggcctttttaaatatacaatgtccacagatggacctgtgtcttttgttcctttgtggcaaagtgggctctgtaggggttcaacttaatcccacactgaccaggagctggcatcagctctgttgccccaccccttcattcttattgaaaatagcccaattgtgcagtgtgaaatctgccactaggtaacttttttttttaattcactgattacagctcgtttcaaattgtgtctgagctcctttttaaaggaaaaaggaaaaaaataaacaactttttttgtgtgaatttcatgctggtgacaaggtgccggattgacagccctggagactgaaatcctctatttatccacaggacaggtacagcacaggcagcgaca

SEQ ID NO: 8423 - DNA, 1155 bp, Homo sapiens
tgtaggatgaaattgggcatggcggtatacacctgtaatcccaggttacagggagcacagagatacagaggctgagattcgaaaatggcttaaaccaaggagtttgagactagcctgagcaacatagcgagaccctcggtttttttttttttttttaaagggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctggccacagtcgtaggatttggggtgggggggtgggattcttagacctagccatgcaactctaattcggtgtgccttgtttttctttctcccttaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggtaagattgctctaccttttgtcttatttatgccaacacagtaatgtgtgtgttggggagagctgcagtgtattaaatatgggattacatgggcgatgggtaaagatggccaaaaggtttttttttttttttgctagctctactttcttagagtgtagcagaaaaagtaaactgcagtaagttttcaaggggttggtgggggggggagcacagattgcccgcatttaacttgatggtttggtaagagggaagagtggtccttgtcttcagtaagagtcctctggctagagcactcacaaaatcaaatgtgggtctctcttgttctacatagcatatagactactatttctttcactgatttgatttggagtccaaagcacccttaattgtaataaggacattggagtaataggacagcaaggcagtttctgggaggcagcaattaccatttattctggaaacacccatttttctcacactgcatg

SEQ ID NO: 8424 - DNA, 2738 bp, Homo sapiens
ccctacacattgatagaactccagggctttaaagtaaaggccttgagttgtctcagcattaaacccttgagactactctcagatgactctttctttcctaaactggtattctgtcagcagtttgggaggagccaaagtgagctcagcaataaagaaacattgcttctgtgtattgtgagcactctttagaggggcctgtttccagaaagtacactccttggttagcccaccatggaggtggaactaaaagagaacatagtttgagggacattggataacaagggctgtttcccttggttctgaggtaatagacctccacatgcttgaattgcaaggattaaaggatcatggtactggtaaatttaagaaaccttaaaatgtctcccttggtactccagcactggttatttactcttcacatttcatgaaccaggtagagatgaggtgcagctgagcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgtacaaggaatacgagtggctttcatggagggagggaagctgggggccgcaaggcatcaacgctgttggagttgtccaattcagtgctgtcacagtctgagtcctcagaattgggagggccctgtgagaaagagtagaaatggagtgagattccttggggttctttgctggggtcattttaatagccagtggcttactgatttgttttttaagacagagtctcactctcgcccaggctggagtgcagtagcacaatctcggctcactgcaacctctgcctcccaggttcaagcaattcttctgcctcagccttctgagtagctgggactacaggcatgcaccaccacgcccagctaatttttgtacttttaatagagatggggttttaccatattggtcaggctggtcttgaactcctgaccttgtgatccacccgcctcggcctcccaaagttctgggattccaggcgtgagtcaccatgcccagcca

SEQ ID NO: 8425 - DNA, 1192 bp, Homo sapiens
cccggctaattttgtatttttagtagagatgaggtttcaccatgttagccaggctggtcttgaattcctgacctcaggtgatctgcccgcctcggcctcccaaagtgctgggattacaggcgcgagccactgtgccggtcaagattccgtattgttaagaaacaaaaagtaaccgtggtttcatttgtctgtctgtcttataaataatcagagtttccaaatgaactgtagtttgtctaagtatgagactgagaagactggaaggaaataggaggcaaaattgaggactcctacaaaagggaagcttggggacatagtaatgagacttgctgtggttaccagaggctggtatatccttttaccagatcttactactctacctaacatcaggtgtgatttggaaaggattaatgttcccatcaagtaacctctcttccttcctgggcaccaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtgtgagtgggtcctggatgcttattggaattgttgaaaatccagaaagtgggatggaatcagaaaaaagtggtacaatttgatagaagatggtaattctctaattaggacagatctagttgtcccatgaagaatctcttaacggtcagagttgaaatctctttcataggtattggtgaagacactcaccatctacccccaaatctcctattagagtcatccttaaacgcatttggatgaaggaattagattaagcaccccagggtgctcttttaaatcatctgtagaatctgactggggtcatgaaaaccaaaagggaaatgtgtttgccctagataatgcagcttaataaaagagagaaagaaaaaagtgctacaagcacaaatagaataattataatctataatccataccttctcttgaatgttatttttccttctgattattaaaatattaaatttaaaaagcaatatataaatacatttctattataaaatatacacacaaatgtacagaatagaaacaaagtccctctttaatctgcc

SEQ ID NO: 8426 - DNA, 1177 bp, Homo sapiens
tctcccttccccgctggcgttcacggtcactgcctcacgggccggccagagggtggaccagcgtaatttacgaggcgggaggagaattcacccttaaaggggctaccagccattgaggtcccactcagccccagtttcccaggcccgtgagaatgaaggaggggggcgctccagccccccacccaactcccttctctcttcctcgcccgccccccaacattgccctttgtcttcagaagggctgcctccgcctcctggcctgcaaacctccacagcctagcacatggaccagagcagagggaggggcacagccctagaacccattggaggtctgagaatggcttctctgagtgggaaggactttcatccagactccttcagaccccagccccagcccagtagacgctgggctggcttggaagagaggagcagtgagagaaccatcaacctttctgtacttcatttttatccttctccccaagagtcccccagcctcccatctgctgtccggccctttccaggagcaagaggggtgagaagcagggcactgatgggagttaactgcagcctggacagtgtgaaactggcctgctggcttggagtgtttcccatatggggagagtctcccctaacaaactctccaaaggcaatccaccgagctttttactctcccaccagcacacagcttctgtacaggcagaggcaaaggcaaacacatacacacagctgagcccagcacagcactgggcccaccccactctccctagtgcactcgcaagcaggcagcctcataatccccacatggcccagcagaatggagataaaatcacatgcctccatcccccgctgggtatctgacacctgacaattccccatccacacatacttgcttcacccatgtacaagttcccccaaattaccaccattccagctgtctgcagtctcctgtggtcttcccctgggcatgaagcactccccaccttgactggtcacccactgtaccccctttatgcagcccttcctgtgacctctgggctctagggtgctggatttgagctctaccactccagactaacctgattcccaatctaataatgaagagggaccagaacactctaaaaggagtgaggggacaaagatatgcaatattctctttccatttgctttaaacttgact

SEQ ID NO: 8427 - DNA, 1558 bp, Homo sapiens
aaaactagcctgtgattttttttcactctaagcattaagagctcctaaagccttttgtcttgttacttttttccccctcttgcatgctagaggtggaaggtagtcatttagatttcccccctcttccctcttcattgttggccaggggttctcttgggcagctgggggaaggatgtagtagatctctcttttttttttttttttgagatggagtctcatgctgttgcccaggctggagtgcagtggcatggtctcagttcactgcaacatctgctttcccggttcaagtgattctcctgcctcagcctcctgtatagctggaattacaggcatgtgccaccacgcctggctaatttttgtatttttattaaagacagtgtttcaccatgttggccaggctggtctcaaactcctgacttcaagtaatccacctgtcttggcctcccaaagtgctgctgcctggctggatgtagcagatctccaattgccttaccaaacctgcagggtctctgttaagtgtctgttaggggtcttatatgatactctggacaccgtgagaaacaggtgatggggcagatgggaacctggtatccaactcattttttatgtctgctgaatggttgactgggtgcccctttggtaagggctgggaaagtgaaccaagttgggagcagagcaggtcttgagaccaccttaatgaggaacacatggtctacttcctatctcctgggacacaggtcatttccagcttccagaattagtaagatttttcatataaatcctcccctacttcattgtataataaagaatttggcctttgtcttcagttcctgagaaggagactctaaatccttggaatttcccaagtaataggagtatctttgtttttcgtggcaggtccctgaaactacacctgaatttatgttgagatttgaccttaggctgcacctaattttatattgaatttgatctcagaccacacctgagtttgctgtaagatttgactgaggatggaggctgaccatgccagaatgaccaaccatatagttacagggctgggactttgagctggatgataccagcttgatccccagggaggggagaggggctagagattgagttcagccacatgccgatgattttaaccaattatatctatggtaaaactctagatataaaaacttctgacacaggttttggtcagcttcctggctggtgaacacatggatgtgctgagggatgtgcattggtatcctgtttctatgagcagagggcacacatctgtgcctgggacactcctggaccctaccatatatttgtcttcatttggctggttctgatttgtatcttttgtaatagaaccataatcataagtatagagttttcctgagttccgtgagtcattctaggaaattctccaacctcagggtgggtggcggggggttgtggagactcctgaatttatagccagttggtcagaagtgcaggtggtctggggatcctcaagctcgcaactgacatctgaagtgagagcagtcttggtggggagtatgccctt

SEQ ID NO: 8428 - DNA, 1048 bp, Homo sapiens
gaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtgga

SEQ ID NO: 8429 - DNA, 1048 bp, Homo sapiens; identical to SEQ ID NO: 8428

SEQ ID NO: 8430 - DNA, 1093 bp, Homo sapiens
tgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtg

SEQ ID NO: 8431 - DNA, 1134 bp, Homo sapiens
ctgcaacctccgcatcccgggttcaagcaattctactgcctcagcctcccgagtagctggggttacaggcacctgccaccatgcctggctaattttttgtatttttagtagagatggggtttcaccatgttggccaggctggtcttgaactcctgagcttgtgattcgcctgccttggcctcccaaagtgctgagattacaggcgtgagccaccatgcctctgactccggagtatcttataggacattagagacttttagggttcaccaccagtcttctggaggaattccaggaaagataatcacatcttacaaaaatatctcttgacatcactgtcacttcattgtcactgtcagtacttagtattaagttctaaaaatttttctgaattggtgaaagaaatgatatcaggagatattaacttaggttatgttttgttgagcctagaagcagggagtttctttactctttccacaagctgtaacctttctttatcttctatttatagcagagcaatgatatcgctcggggctttgagagaggactggaaccagaaaagatcattggggcaacagattcctgtggtgatttaatgttcctaatgaaatggtgagagagatttggcttcgctttacaattgtgtttctttgccagtgacttgaatttgtgtggaagatagggtggcaagactgcatattcccaaaccatgaattttgaatgtcagagatctttctttttttgagacagtgtttcgccctttgttgcccatgctggagtacagtggtgcgatctcactcagctcactgcagcctccgcctcctgggttcaagtgattctcctgtctcagcctcccgagtacctgggatgacaggtgcccgccaccatgcctggctaatttttgtatttttattatttatttatttatttatttatttttgagacaaagtctcttgttgcccaggctggagtgcaatggtgcgatctcggcttaccgcaacctccgcctccgggttcaagcgatactcctgcctcagcctcccgagtagctgggattacaggcatgtgccaccatacctggctacttttatatttttagtagagacagggttcctctatgttggtcaggctggtctc

SEQ ID NO: 8432 - DNA, 1173 bp, Homo sapiens
tgcctaagcaagccttttttgtgtgctgctaagagactgggcaagatgctcagagcacagaaaactcatattttagtggcttttcttttttcatttttataaagacgcttattcaccttggagaaaaaggttttaattttatcttggttcatttaactaaagattttgcacatttctgtttgagttcctggcttgtaaacagttacaaacatagccaggaataacataccacactacttgtcttttggaatctgaaatagaagagttaaacagttgtgccttctaataattttggtctctttagccgaagaggaggttgtagttgaggaagtgaagactgattcatttttaaattaaactcttaggactcatctgtagaatgatttgagactcaagagcagggcacatggcaactcagtgttatccccttttcatcccatcaagaaaagacaaagtttttaactcctcacatggattctaaccattttgtcctttgcctttgcagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgagtaagttccttttttcccccaggcgttgggactctgtagagatagatacctttggtttacttccttaggaatcacaagcatttttgtctttttcttccccctcctgcactcttcctaagagttagaagacacagcagtaaagaaaacaaaatctctccgcttgtggagcttacgttctaatgatactgcttttgaaaggcagtataatgaattggttaggagcacagactcgagagtcagattgcttgggtctagattctaactccaccacttatgatacaaactggatggccttggctaatttccttaatcattttatctcctcagtgaaataaggataagcagtagtgcttataaggccaggcgtggtggcttgcactctaatctcagcactttgggaggctgaggcgggtggatcacctgaggtcaggagtttgagaccagcctggccaacatggtgaaactccatctactaaaaataaaaaaatt

SEQ ID NO: 8433 - DNA, 1452 bp, Homo sapiens
gaatttaacttttattatcccaaatatgaaaacattactgttggcactttgaaactttaaaagaaaaattgtacttttcaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtt

SEQ ID NO: 8434 - DNA, 1452 bp, Homo sapiens; identical to SEQ ID NO: 8433

SEQ ID NO: 8435 - DNA, 1636 bp, Homo sapiens
ctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaactgcctttgtgtgatgtttctgtttctcttcctctctttttggcagctactcctgttcctccagccccccgtcattccccatcttataatatttcttccctcctacctcagagactcctagcagtgcccccccatccctaatttacggggctgtttgcctccttggcatctctccgtcccctcgcctggaaattggcgccaggggtggggtggggatggtattttctcagtgggagtcccagggaactgagttcttcccccatcacccccaaagccagctgcctgctcccgcctcagccattagtaacccagagacgcgcacctgcgtgggggctcttctccagcccttgctcacttcctgcacctcccactcctgctctgaaacggcgctgagcgggttatttatcggagccagcgctgctccagaaggtcaggacggtggtgtaaataacctcttctcgccatttccccgtccctccagagcctgctcccctccccctcctccacc

SEQ ID NO: 8436 - DNA, 1128 bp, Homo sapiens
ggccagatgggagggggccggtgcttggagcttgattatactccctcgctgttgcccctttccgggagctcacagccccctatccactggcccccgcagcacatctccagccggcggcaccgagacggcgtggccgggaagcccaacccactactgagccgtcacaagaagtctaggggcgccggggagctggcggtgaggcctggatgctgggaattcagcagtgggagggcgcgggcggggaggagagagggacgcgggctttgcccagggagaggtggggtttgcaggaccgccgggtgacttctcttcctccgcctttcgcccgcttcagggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggt

SEQ ID NO: 8437 - DNA, 1181 bp, Homo sapiens
gggcctctccgaccttcatcactattcttaggataatgctggcgggcagagatgatcaatcatcatattaaatcataatgagcttataatcctcccactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctgggtatagctgttgctccaggaagggatttctcttctggatcttaaatttcacagacctcattaggttgtatggccctgagagtgggtatccttgagggagtacaagctgtttcaacttagcccttttctgcgctaattagaatttcaagcgtcacagagcctgggggctttcaagatagcactaaactaggtttacttaactccttggcaggaaatagtggcccccatgcatcacttctgtgaatccactgccagggagaagtggagaaacagatcatatatgtcacaggtctagagtggttggaattgacaaatataattagctagttggttaattagggtcatgtccatactttcatgatgaaagggaagcagttgtcggttttcagcaaaaacgattcagccttcctgaagcctatttgatagctgttttggggttttgtacatgtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggctta

SEQ ID NO: 8438 - DNA, 1188 bp, Homo sapiens
attcctgaccacaaaaggacagagatgaaattctacattcacacagcccgccaagttagccaagctccctaggaggctgtctgaagtgcctaaaatgcttctctacaatgatcacccagagctgagagacttcagtggggtagtgagaagaaagagggttgggagagacaggaaagcatcctctccttgagggaaggaactgggaatcaactgagaaccagctagcactgccaggaggtgaggagagggaaggagaataatttaaatgaggccagggagcttctgctccctcaattaaacggtgatagacggcctgacaccaccagccctcgaagcctgagatccacaggaaatgttaaaaactggcttggcaatataagtattagaaaatacttcttccaacactcaccaaaaactaagctcccaataaagaacacttcacctgccctccgcaaccctctacctctcttccccgccaagatcttcacccaaggtctcaagagggcggttcccaacctcacgtgacacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcagggtgagccaaatatcctgtcggccgttttctcttcggccgcggcctagcttcagcccggagcctggatctcgagtaactaaccatatccagggaaagacgccagctagcgggcaacgggcatgggggagagggaatttcagagaggctttttttgaaactcctttcccttgccaactggctccggtcccttgggcaatactccggtcccctcggcaacgcccccaatccccgacctgccgcaccttagccccgcccctgccccggagcgccctgcctattggccctgggagcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgc

SEQ ID NO: 8439 - DNA, 1188 bp, Homo sapiens; identical to SEQ ID NO: 8438

SEQ ID NO: 8440 - DNA, 1114 bp, Homo sapiens
aaccttagtcacagctgatgcgcgcgtgggatgtgcactggaggatagtgagggggcagttctgggagagaattgagctgggagccctggaggcctgtagaaagcattattctaggtcagaaatacgtgtcttgaggtcaaggctttctgggaggtttttgaatttggtcatgtccctgattaaagagccgggaggggatcaggggaggtaggggcaggcaaggatgggtcatccccctaccccacagccaaagaaattccctagaggtgtgagaatctctcttccggatggggtcaagtctgtgtcctaggtgtaccccctgccctccaccatggagggccactgtgttgtggatatggcctaatcctcacctgattttctcttaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacggtgagttgggggcgggaccaacatgggcggtctgggactgccagagcagcttggttcgggctcaggaaggtgggtgaggtgggtgggtgaggaagacctttgtgagtgtccagggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtaagcagggaataatgggaagggcctgcctcagccgggtctgggaccctggtgcttgaattctgactgcaacagtgctcctccgtactctcaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctc

SEQ ID NO: 8441 - DNA, 1130 bp, Homo sapiens
ggctttgatgacttttaaaaatattaaataaaactttatttacttccttaggtctgtcatctgataacaaacctatggtaagaaatctttttttatttcttacacacccagatcttaattctatatagctaactttagagactcctcctccccagattagaggaaactctgagaacattaatttgttgactcttttcagtacaatgttgtatgtcttgaatttaaaaaattgttggagatactgagaggtcaggaaaattgtcacatgttcaattactgcagacgtcttccttcctaccactctttttgaaagtaagaatggattttgttagccatgtatgtaactgttttatggtactggaggccttgtccagtggccttagataatgtctaattcataattaccacaagagaatctatggaagcaatttaggagttctgtttgtagatagtgcttttttttttttttttaaaatactatccgtgaaatgtgaaatcagagtaaagaatggtagaataaaatggctttctggaccattgtgactagtcagcatatttaaaaaatggtaacgaatgctgtggtgaaatagaatcagctttatgaaatcctgctttaggggttgctgtttaatattgtaagtgaaggtttaatattattaatgaaaatttcctaaatattcttttttttttttttttttttgagacggagtttcattcttttgcccaggctggagtgcagtggtgcgatctcagcttactgcaacctccgcctcccgggttcaaggaattctcctgcctcagcctcccaagtagctgggattacaggtgcccgccaccatgcccggctaatttttgtatttttagtagagacggggtttcaccatgttggccaggctggtcttgaactcctgacctcaggtgatccacctgcctcggcctcccaaacttctaggattacaggcgtgagccaccgcgcctggccctaaataattcttaacaatagtagcaagtccatgtaccaaggtttccaagaaagaggagggaagagaatcgagttgggtagtagttataggttgtcttctgaaaaaggtgcttccgtgatagtttctctttgtttggagatagagtta

SEQ ID NO: 8442 - DNA, 1367 bp, Homo sapiens
caagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagccttatgaggacagctctctacccatcctgattaaactgcagctatagctgaaaaaaattattgtaagaaaaatacacagcaaaacagagctggaaggtggtaagtgtaaaagatatggaaagatgtaatcaccaa

SEQ ID NO: 8443 - DNA, 1255 bp, Homo sapiens
caagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctctgctgttgctgctcttttctttctctgcaccccaaaacaaagagctaaccatcttgacaaatcctctgtcccctaaagatctaatagagatgcccttattatacagactactgtaagagttatacagccagacagctagaggaagagctgttcagtcctctcttatgaacatggagttagcttttattaaacacaaatgtaccagacactgtgccaggcacttcacatacagtatttcatttagtgcaacaatcctgcagtactggtcttaacctaatgttgcaaatggggaatctgagattcaacaaggttaattagcttgcccgtaatcataagcacataaatgtgattctcaaggattccaaggcccttgctcagtttactggccatgctgttttcttgcattttatgtaggaagaacaggacccaggcatctccctccaccattgacctccagagaagagatgacacagttgga

SEQ ID NO: 8444 - DNA, 1210 bp, Homo sapiens
gggaggatggaagtgagaattctgccttgggtagaaggagttctggtttcctgatttctgggaacacctgctgcccatttagtccactatcacatcattgaagtcaacatgcatctctccctctagcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttg

SEQ ID NO: 8445 - DNA, 1907 bp, Homo sapiens
cctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacac

SEQ ID NO: 8446 - DNA, 1057 bp, Homo sapiens
cgcactacaattcccaccaagcatctgtccctctctggcctctaataacgagtgcgccttgtggtccagcgtctggcaactttcacgcctagcgtcgcgtataccggaaaactgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatggtgagtcttcttgcgtggtgagggtgggggttcgggtgcagactctgggattgtggggaagtgagagcctggagcacggctgaggggtggaccgagtgtacatttcatttgctctgggggtcggcgggatttgcggagaaacaggagatccgagcggcgccttcctggaggctgccggtgcggcttgtggccggaaagggactgaggctgggtgagttgcgccgttttcctaacagttttcccatcctgtcgcagacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttctttggagcctctcaggcaatttccacgtatttaaggttgttactggtagaagagaattctcttgtttgccgttttgattcttttctgggcagagggtgactttgtgataga

SEQ ID NO: 8447 - DNA, 1204 bp, Homo sapiens
atacctgtaacctcaacactttgggaggctgggacaagaagattgctagaaaccagcagttcaagaccccatctcttcaaaaaatattgagaaggaagccaagcatgatagtgtgaacctatagtctggctgctcgagaggctgaggcaggaggatcacttgagcccaggagtttgaggttgcagtgagctatgattataccacttgcgctccagccagggcaaaagtgagaccttgtctcttaaaaaaaaaaaaaagttgcttcctcctgtggtgcagggggtatcaaattaaggtctgtgcctcaggttaagctgtaaggcaggtgagacccacacctgaacatgcttagagacactgcaaagcagtgttagaatcagaattggtttttaggatgcagagtagtgttctccctccacctctatcagcttcccatgcatttgtagcctgaatacatcagtttgtgagaggatggtggtcaagttctttgggggaagggagtcttggatccatgggttttaatttactcttttgtttctttgtctttcagggtgctgccccacgtcccccaccaaagcccatgtaaggagctgagttcttaaagactgaagacaggctattctctggagaaaaataaaatggaaattgtacttaatattgcatgttaagtgtatctgtgccagataaggtggggattttgtgtgttagaccaagtgtgaagtgacacacattattttcatggggaagaaagcttattcatgtaatttaatttttttcttttttttttttttttttttgagacggagtctttgtcgcccaagctgaattgcagtggcgtgatctcagctcactgcaacctccgtctcccgggttcaagtgattctcctgcctcagcttcttgagtagctgggattacaggtgtctgccaccatgcctggttaatttttgtatttttggtagagatggggtttcactatgttgtccaggctggtcttgaacttctgacctcagttaatccaccagccttggcctcccaaagtgctgggattacaggcttgagccacctcgcctagctatttatgtaaattaaactttaattgtggtcgtatggttggcctcacaattcgcatagctgtgtgaaatggagattaggcatctgaattttggatttaaccacatcaagtttaagttggcatcctaaaaa

SEQ ID NO: 8448 - DNA, 1648 bp, Homo sapiens
gctcctcttttttcttctctgatcatatgcctctctgtcctattaattttttcaaactttcccctaccctcatgaagttcttcacatacctagcctttcttctcaacccccaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctctt

SEQ ID NO: 8449 - DNA, 1168 bp, Homo sapiens
cctaggtgtagacactgcccacccgctgcggctccactctactccacccctgcccgctcgactttaaacctatttccccgccgtagctccgcccctctcccctcagcccgcccctctctgttactggctctcgctcagcgttctcggtggaagtggtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttc

SEQ ID NO: 8450 - DNA, 1261 bp, Homo sapiens
gaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaattcctttctctctattccttttaggaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttg

SEQ ID NO: 8451 - DNA, 1873 bp, Homo sapiens
tataatcccaacagtttgggaggcctaggcaggagcatcacttgagcccaggagttcaagatcagcccgggcaacatggtgaaacctcatctctacaaaaaatacaaaaaagttgtacatggtggcatatgcctatagtcccagctacctgggaggctgaggtgagaggatcacctgagcccagggaagtggtaccactgcactccagcctggaaaacagagtgagactgtctcagaaaaaaaaatacttttatctctggtcccagacatccccaagtagttagaaactgacaggtcttctccctctccttttcttgcatataggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatgatgtgctttgtatgctgctcttgtttgatggaggtggggagaatgtcagttgaagtggtattggaactgttcctccacagtgccatgctctaccttcccaaaacgaggaatgtcttgacttgcagaagacacaaatcttagaatctttgatgatatagtaatctgctggagttgggtggtgtaattttctaagtagaaacagtcctcactgctaagatttgtttggggctaggacacaatgtctactgcaaaaacagtactgcaagtgtttatcttgaattcaagaagccaggaagaatggtacactagttttcagggccagactaaggtcagatgggtaattagtttatcttactacatgtcaggaattgctaaactagagatactacaagtgaacagaactgaacacaggtcaaatgtgtaatgatgtatatctaccattaaaatagagtagttttagtg

SEQ ID NO: 8452 - DNA, 1364 bp, Homo sapiens
gtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggtacgttgagactttgccagcccaggaggagggaagttccttggacaaaacttaggagaaacatttggtttggaaatcttaaaagatctttaggagaaaaacgtttgagtgttttctccctggagccaggatttaacagaacagagaacgatagaaccgtagtgcttgttcattttaccacctcattctttatgtggacgtttgatttaatgtgggagggaaaggcaactctggtttgaggtgtattccattcctgtgtctgcttttcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcttgtctattatgttttttatggttccatcgggtgggggttttctgtcattagagtttgccctgtcactacctgtgctatggagggtatcaaagctataaaggcaacagcccgggttacgtggtgtggtttgcatctcgctggagttggatgggatatggtacgtctctggaggcaggttttaggtttcgcgggttattaggggccaatgctggtaccgcccctttccaggagggctgccttggcgactaccgcttagaccatgtcgtgcctttgggttgggttgccatagtgacacgcaaagcgtgctgggaacgccctgcggcatgtcgcacgcgtacttcatacaccatagagtatggttccgggtctgctggctagagcgtcacttcttccgcaggaagcggaagagcgatcgggtaggcggctctttgtcgaagctagaggaccggcaggcggcag

SEQ ID NO: 8453 - DNA, 1364 bp, Homo sapiens; identical to SEQ ID NO: 8452

SEQ ID NO: 8454 - DNA, 1481 bp, Homo sapiens
ggcggctgctggacggagggagggctacgggaggaggtggtgcggctgctgcagtgcccgcggcgcacactcccccgcactcctcggccggccacacccttttccggactgtgggctgcgcttgttccgttggggcagagacccttatttctgcggcggccgcgtctcctgtgctgaggcggatgccttctctctagtcttgcagaggcgaagccggttacccggcccctcccagcagaggtgccagtctagggggagaatggcagcagagaggaatcaaaattgacactagacagacacagccaagcttcccaggccctggactggaaaggggaggagaaagagggccaaatggctctaggggacctgtagcctaggcagcaagtgtttgtctcctcctcatcatcatggaaaccaatcttcctacccccaatacaaagcgcaggtgtcctttcccttaaaaggagtcacacagagaaagatagaggaaaacacacacacacaccccaaaaaacccacaaagccaggcctaattaggtcttctggcccctccctgactcaaggaaggacttgcttccctcttcaccttcctgctctagaagccccgtctgaggggagttgagaaggctggaaaaggggacttttttttttttcttttttgagacggagtctcgctctgttgccaagctggagtgcagtggcccgaacttggcacactgcaacctctgcctcttcaagcgattctcctgcctcagcctcctgggtagctgggattacagtcacgcgccaccacgcccggctaattttgtatttttagtagagacagggtttcaccatgctggtcaggctggtgtcgaactcctgacctcgtgatccgccggcctcggcctcccaaagtgctgggattacagatgcgagccaccgcggccagcctggaaccaggactttttaaatcccaggattccctcaaactccaatttgactggacctccccctccagaaagaatgcgcccttctcctcctcccgctcctctctctctcagcagctgtcatttcaccacgtccctgagctatccacagggcaacagcgtgacctctaccttgtcagctccccttattagagagacatcagcccccaaactctgtgaggaatgaacctttggggcatcctcgcccctcgcccaccctgagtgtgaggagtcacacacactccctctcctctgtggcacaccaccagcatcttagtaggaaaccagaggcgagggtgtgctgcacgtcactgtctctgccttccccacctccaggtcagcttcccagacgtggaaaaggctgaatggctcaataaggtgaggattgatttgatttttagtcttcatgaggggagaatgggaatttgtttcttcttgccagacccatcctcaaccctcagtgctctccgtggggaggattctgaaggaacttgccttgagagggaagactgg

SEQ ID NO: 8455 - DNA, 1197 bp, Homo sapiens
gatcatggtcctgttgccccacaggttcggggtgagggcactggcgtgctgggctcattatccctgcccctctcagagctcctcgtggctgaccagctctgcttggaccgctggtttacactcagcagtggtcaggggcaggtgctactgagagcacagctaggggtgagtgacaggagatggtgggcaggatgagagggaggaggggagggccttcacaggtgagggacacccaggagggtgggaacagagggccgtgtccttagagtgagggaactgagagaactctgcccagctcacagctttcttgcccctagatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacaggtaaagggctgggacaggaaggtgggacgcagtcagaaataaaaagtattacaggttcactaggctctagctttccccagacctactgatatttctccacagtccccttgaggctccagccgggcctctgggccaggtgaaactgactctgtggtactacagtgaagaacgaaagctggtcagcattgttcatggttgccggtgagaccccatccctcctgtcctccagatcgcctccatcccttccctcaggttaccatatcacctacatcctcctgttgtaggtcccttcgacagaatggacgtgatcctcctgatccctatgtgtcactgttgctactgccagacaagaaccgaggcaccaagaggaggacctcacagaagaagaggaccctgagtcctgaatttaatgaacggtcagtcagtgggcattcaggtggagagatggcaggcttggaaaggactcctggcccctaacatccagtcctaccccaggtttgagtgggaactccccctggatgaggcccagagacgaaagctggatgtctctgtcaagtctaattcctccttcatgtcaagagagcgtgagctgctggggaaggtaagagggcaggatggcagggcagaggtgagggctggaagctgctggcaccaaggttatagtccctgtgaggaaggaagtaccccacgtgatcctttagaggtgactcacctctgcaatggtt

SEQ ID NO: 8456 - DNA, 1225 bp, Homo sapiens
gcgagggaaggggaaaggactgttcagctatagcagcagaatggggcaggcaacccatacccctctatgccagctacccatgctccagggccagaaggtcaccctaaagcaagactggtatacaggctggtgagagttcccagacaccagcacccagggccgcataagtaaaacctcagggcccattctagaggtaaggaggtactgtacccccaggttgtcttcctctttgaggaatccctcccctccctagtcagctccatgcagaaacatgccaggaggaagtcagatggtagtagggtaagggcaggggataaagagcacaggttggggaaaaaagaaacactggggagatcaactagaggagaggctgggaggagccgtacccgccccatgggcccgtcaccccgacaggatatgcctcacaaacgctgcaggaaggaagagacattcatggtgaagacaagacaaagacatggggtgaggggtcaggcagtggggacagacattccattatttcacttctcattccttcccaccctctacaatactacccccttcctttcctgttataccgccctgacctcccactcctgggctgggctgggcagggccctgcaccttgcctcctggctctttttggagcccaagtccagggatagggaaagccccagacactatacttgacctgccccatatggctgctttctctgagaaagcgcagttcacctcttaccttcatagttgatacaaccattgctgtcctcatgccctgccaccagcatctctacttcttcctctgtcatcttctcacctgcagggggaaagaaagcatttttggaattgggtgacaagtgaggtacctcagggtgccatctcagctcaaggacaaggacacagaaccttacccagtgtgacaagaacatgccggatttcagcacccatgacggtgccatttccttccttgtcaaacacccgaagtccttcgacataatcctcataggtgccctggtccttgttcttggccactgtctgcagcatgggcagaaagtgctcaaagtccagcaccttcacattcatctctgccataaaggaggtggaagtgtcaggccagagaagtaacacaagttctcaggacaggggattatagagacctcaactgaacagagagatgacagatgactccccactaaaagcaaggaaatccatgggatttgctaatcca

SEQ ID NO: 8457 - DNA, 1669 bp, Homo sapiens
atttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccatcttgtgggtgcattctgtgttcttacctgtggctgtcaggcagggggattgtgatgggagcagctttcctggagtccttcacagcggcgtttacctgggccgaaagacactctgcaagccacacggcctacagacactgcgcctccccacaaaacacgaacggcagcacaactgtcgagactatgtgctggtataggagcagaggctctcacctgccctaaaagctgtttaagacttggaaggacattcccacaacatggaattttgtatctctgtcccttcagaagtagtggtttcactccttcccttattagagaggaggcaagccccttacctacttttgttataattggcccttcaccctgctgaggtgacggacaggcttaggcagtgctaataatggcctggctttagctccaataaacactccacaggcttccccacaaaaggccttattgggagcttgggagggcgggggccagatttaaggagctggaagggtag

SEQ ID NO: 8458 - DNA, 1127 bp, Homo sapiens
gaaacctttcctcgattttacaatgaagtcaccttgcaacctagctttgcagtaccctgggtttggggtcgagaggttagggtgagcttcctatctctagcccctcacacccaaaccccataactggagatcataaggtggtgaacaaaaggttcaagaatccttacctgtcttttctaccaaacctcttcctggtgtcgtctttgtctctaggcctggttttctctggaaatggtctgcctctctttttctcactaccctcagagagggattctctttatggctttctttcagctccccagttcttcctgccggctttgcagctcgtcagaagtgtgcttagtggcttaggagaacttcctactgatgctggttgtgagcctggccctgcccttggggtctctctgggtgtgagaatcctgacaaatagctgctatttctatggcatgtctctacgcctgtgagaggctcttattcccaggcttctacctttgaccttttgcagggagatcaggctaggggcttagcctccggccttgggggaattgacagttgtgacctggttcagcttccatgctcttagctctttgtcatttacctttcccttcacagatctatctcttttcacctctcactgagaggcactgtcttctttgtgatgagtggggagaaaacgggtcaaaaagtaaaaagaaagtctcctggctcaggttcaaattagaatggaaggctaggatgctactaggtagcagagtgtggaaacatagaagtagggccagggttacttgtctcagatacagtttcctcggacagggtagatgttgtcttgctcttctccatcaggctgggtagtggatggcccttcctgtctaggagggcctatgaagacatttatacccagtcttcagaagcaaaatgcacaagctcactcagtcaacttgccctccttcacttccttgtaccttttcttgttaggctacattatagggggaatcatggctttacagagttcccctaagaaatgtctctcttagagccccagaggtattgcttccatgacctgaactttataaacctccagaattttacaaccctcagtgctgttggttaaagatgaggtgccaaga

SEQ ID NO: 8459 - DNA, 1204 bp, Homo sapiens
gaacctcctccagggtcttggaaggagtcctgagaggtgggattggggccgggctggcagggctgagtttgcgcactgtgtatcttatgcacatgagtgtttttgtctaaatgactccagtgactgctccagcggggaggccccttcctccttccctctcagccatttctcacccacttcccatacccagtgttcatcccctacctccccttcccaccgcaaaggaaaatagccttacagaccctagcccagaaaccctactcctggggcaaaccagtatgggcccccatcccgcctagtttgaaccctaccttttaagaaggagggataaggaacaaagcagccccttcccctctaattgtggtggctccagccttctgcagccttgacccaggttgggcaagggcggaggtgaggaatctttgaggaccaagcccagtggtctgggaatcgggaggtagagagggaagggtctgccttgggggctccctcctcccaacccaacccctagagaagcgaccaaatcccagagatggggtgaagctggggtggggagggtctgctctttgaattacttgaaggtactgactccaaggctgctgttgcccacttaggtgtgagggggacactgtcactgcatttgggagggcagagggtggcgggtaaccagaggatccaccttggccctcacccactcctgctaggccctttccctggggaatctggaagcctgactttgcccccagggaagttggggaccgccttccctcccttctccacctctcactctgggcaccctctccaattgcactaaagtagctgttgtgccagtctgccccccacaaggggggaggtctctgcttccagtcttcttcccccgctgcctccgctcccaccctggacaatctccttgtttcccttgtgttcctggatagctcagctttgtatgtgtgtttggggggtgggggtgggttctggcttgagtgggtttggcaggggtttgggaagggttaggggaggatggaggatgaagtctcctacccccttctccagctccaggccacagaagcctgggaagggagggtgcctactctcgctgctgtgtgtcttgcagatgtgccaaaatgggggtgggtgggaggggagggtgcctggcagagcagcccctggggtggctctctcaaagcaatatagttcccctgcg

SEQ ID NO: 8460 - DNA, 2440 bp, Homo sapiens
acacctgcctaatgaccccatgtttaagttggttgctcagctgtacaagattgtgcccaatgtcctcttagagcagggtaaagccaagaatccttggcccaatgtagatgctcacagtggggtgctgctccaggtaagtcctcctttccctcttttccctctaatttgtaccaaaccctattgttatctgccatgcacaaagtcaattaactcctagtcagagcagggacttccctcacagagcattttgataaagttgactatgagagggttgggggttggggttgctctgttttcagaatcccaattgctatacttttctcagtgtcatttctatttaaggttgactgggctaagtccttggagaaaaatggaaaatttagcttttaaggtttctatcacctaggacttgtacatgccactgcctctgccttaaatgaaatatttttctcttctaccttacagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatgcttgagcctattattaaataaggcctggaagaacctttattatgaggtaaggaatctggctagcaagatcctgaacttagtgggttataagtaatctgtatccatttatctttaggcaggtttggctttcttttaccttaaccagaggaaagcctccctgagaaatttccagaggagatttctgtccttcctcaaggttaggaagtccttgatgtttagcccctaaccttgctaattttgttgtaaggtaacatactcaagggctatagctgagattctcaattgcttatgtgactaatccaagaactggtctagcccactgagagaaaggaacaaactaccaaggacgaatgggctagtactgctacctcaggaccagagccactagagggctctggtacttcttggagtgcctgctc

SEQ ID NO: 8461 - DNA, 1233 bp, Homo sapiens
caaatgatctccaccgagcagctaactctggcatcctagcctgttgtccacatgatgtcacctccatggccgtgaagccattaaccaaagacattcctcaagaaagcgcgccaaggcggtagaaggatcaggcaatgatcagtttccatgatcatattacggaattggctccaaggaccttcagaggtcgagtcctggagcgtctcctttagcattcgcctcagagataaccccaaaagtgttaaggtcaaagggaaaagccaagagggaagttaactgagttatcaggcacctatttagccacccgcacttccccgcccgccacccatccacccttaattagccctaatccgggcggtccaatcctccccgtcacaactgctgtcaagggctaaggtcccgccccgcttccataccggaccaatggccgggcccggggagagtcccttgagaggggcgggctcgggttccggccagtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggtgagcagcgaggggagggagcacgccgtcccagggtggggctgaggcgaccgcaggccctccggcgccggggtctccctcccacacccgtgcgcaccctgcgcgccttaaagggccctgcgcttggctggccgccagccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggtagagactagagatgtggtgttccactggagttacagtcagtttggtggagggagcgggagtgaagatatgtgctcactctggagcagtggctaatttcgtcctctgctttgtaggaagggccttgtcagttcccgaactgcctgtttccatttctccaagcctattatttaagccttcggtgaccacgccga

SEQ ID NO: 8462 - DNA, 1135 bp, Homo sapiens
tgcttttcttcttccctatggctctcgaccctgctctttccaggtctcctcagccgtgttctctttaccatggtctcctctacaattctttcttgcctctacaactttcaagtctcctctgagctccaccggtttggtggactcactgcttcggtggactcctgcttctgggacattttctccaccagctcacttaacctccatatttctcctcacccccaggccagtttcctacatcagttcttctgcttttccctccaggtgctctatttcctggagcctgtacgctgtctaattcaaaaccacctttgccagaaggagttctgtctggcatgtgagctgggcttcctgtttcacatgttggacctctctcgtggtgacccttgccaggtcagtacttggagacacttaaaatggaaggggaaggaaggtggacacaaaagacaaaataacccctttccaccaacacatttccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcaggtatgaaatcaggatagaaatagttaaagccatcatgacaggcccctctgtgatttaaaaggtctcctaacttcctcaatgtgcatatatcatcctctccactcttagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtggtatacccttcagctcagttgggaaggctccccaaaatgtcctgtaatatcagggagagggtgttggggactaactgtgggtagaggggagaaccaggagtatagcatctaattttccctcagataaaactgggaagaactatgactttgctcaggtgctgaagcgaagcatctgcctggaccagaatacacaggcctggt

SEQ ID NO: 8463 - DNA, 1247 bp, Homo sapiens
tttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagagggtaatagtgcgacagccatcttctgagtattaacgtgtcagccatgttggtctagagggcaggaaaggtgttctgagaatatgaggaccgagttcctaattttgtgtcatttatggtcattgcagaggaagacgctgttggtaaagagccgctgaaggcagcacccaagaaacgacaattgctggacagcgacgaggaacaggaagaagatgagggcaggaacagaggtagggaatttgatgggaccttctttttcttctctaatcctgaagacaaactctaccacgtccttaccccttaacatatttagatattctctctctctctcacccccatcgttcccacagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaactta

SEQ ID NO: 8464 - DNA, 2023 bp, Homo sapiens
atgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaaaatgatttggtaattaaagtttatttgaacacaaaatactttctctgtctataaaattggctgttagcagtagcagcagcatgtcctggccaaggggagtagatttctccagactactaaagccatgtatatagccattcccacttcccatattctgtggatatgtacatgtgcatggtagctagagtccctccaccagagtatctctctcatgatggtttcttca

SEQ ID NO: 8465 - DNA, 1200 bp, Homo sapiens
gtaacaacctctatttcttgtattcttatttatatggcagatacaagagagggcccatgttaatagtctgaagactgccattattcctatgaggatcccatacagggaccagttgaaagaaccttcattacaagctggggttacctcttcaagaaccttgaatttgtgtggcagacactctgtgtttctgtagtcataacatttggagcagttgtggggctgggaacttagagctttgctttctctttcaatgtgtggagagcacagatcctggagaagctagagcctaacccctcttatgctccttaggatggagtccacagagaagtgtgaagccatcatcacccactttaatggaaaatatattaagacaccccctggagtaccaggtgaggcatctggggctcaggctgagagggccacaggttgttacttccagtgaagattctggagcagctttgcatgactgtgcctgggccacatgaggtgggactcagctgcccatctgccttctctctcggcagccccatccgatcccttgctttgcaaatttgctgatggcgggccaaagaaacgacagaaccaaggaaaatttgtgcaaaatggacgggcttggccaaggaatgcagacatggtaagaggacctctgaggagacaggagtactaacgacattaaagtggaacggaaatgatcatggcatgatttctgtgagcttaggtggaaagcttgagagctacagtacgtaattgagaaatgctggctgtgaacatactgccagtttgttctcgagtgtggctttgcggcctgcacaattagaaaaactctgaaacagctgtagtgggacttgtctaggctttaatttgttaaaccaaaacattcccagccttggacattctgggccagctcctattctcactcaagggctcacaatgtgaacactgtgttctttctttatagggcgtcatggccttgacctatgaccccaccacagctcttcagaatgggtaaggttttatataatcaagccacctgaaaatgataatggcctgtgtccagacactcaaatgattcatcttgattctctctatttgaaagtcaagggaacgttggctgtgcctatcagttgggacccttcccttgtggtttcctgtgactcagtactgattgaggttccttcccacaggttttacccagccccc

SEQ ID NO: 8466 - DNA, 1896 bp, Homo sapiens
ttgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtccagagcaacctgccctgccccggtgtgcttggaccctttgcccagggaaccaggacatcagaaataatgttccttctgtggaaggacaacggggagctagggtagcaaagagcaataaattccaactctttatgaggtcaggagtcctttaaaaaagcctatgtcttggtctttaactgtccccttctgcaagatgtgactctatacacatggagacagattgaagaaagacttcacccatcttctaggaaataaaatcctgctcttgtcttctcccagtcactcccttatgcactgaaaggagaatttgactcccttgcacttcaaggccaggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctcccttcccagccaccctagaattgagagtcccagtgcccctagtgtcgactttctatgtacatcctaggggtgagggagtgcggggcaatgggtaggatataaagcgtaaaggacaaattgccgcagtcttctaattgatgcttccaaactcaggaagggcttatccagtgtaaaatagccccaagcccagcaaccttctagagggctctggctgggcagatagcttttgtttttgagtctccagccctcagtcaaggaaaatataccatagctgctttcttgtcagtggcctttgagagaaagagaaaacaaatctagaattctgttcatctgatagaccgggggagctttgctatggtaggaggtttaggaagggcctttcacgcatagaaaccattgttgatattgccactcccctctcctctgcctcacagaactcctgattctgtcttctttctctctctatatatatattttaaaatgtttaaatggctctaattttttgttttgaattttgaatttaccttttggagttcttctcatgtgaatctacttgttagattgtattaatgagtgtttctggtttgggcatgggaagtgatgggggcctgaagttattttgcagtggctaatggcactgaggaatttcttttttggtgcatttggtttacactcatttcctctcctaattgttagttcatttgtaacagtgggtgagtgtttggaggaaaggagggagaagaaaggagggatactgtttctcccatgaaatagtctaattggttgggttgatggcagaaggaaacataggggagccttccagctcacagccaagggttgggctcttaaacactatgcctagtgttttctgaatgctgtcttcatggagcccagctcttactctctttgtactttacatctcacccccactcattacagatgctcataacattcttaaaatattttagtacttgg

SEQ ID NO: 8467 - DNA, 1785 bp, Homo sapiens
gaggcctgtcactccaatgtcaacccgtgggctgttactttgcgtcatatgatgctgtgagaggccttgctggaatgtcctaggaatccctagtagcagtggctattagtcttctagaaaagaactattgctgctgccttgtgcacatgccccaccttctgggcaagtggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtctacgtcttggtgtcttatccgtgagtgggaagtggtaagctggtgatggtcccatatttgctatgacaggaacacagaggtggcagcttaggaagctggggccacatctcacaaggcaggacctggatgcactgaatccccctttgctccagcaactcagccagacatttaggcaggagcactaatgaccctttccatccacacagagggtatggaacaggagcccctgttgttcccttgcctgtggtctcttaagccagtcatacctatcccaacgccgtctccccctcaggtgtgtagaagggaagatgaatacacagagt

SEQ ID NO: 8468 - DNA, 3024 bp, Homo sapiens
cctgccctgtccaggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcc

SEQ ID NO: 8469 - DNA, 1099 bp, Homo sapiens
ggtaaggtcccaaacccagggaaggggctaaagcatcacatttcaagccaaaaccctggctatgcttcacccgccccacttctctcctctctgaggctctactctctgtctggtccctacctccggagccggccttcaacaatccacttgtttttcctgtagctggacatactctccagagtcttgtcaatctcactgcaggggaatagggaataggatgaagtggcagcacaaaaaaagggaaaggaggctcaagggtaaaggggctgcagctgaaaaaggagttccagcctagaacccagattgggtgaatggcagaaggcttaggctctcccagggagggcactgcaattcagtcccaagtcattccagcatcttcagaacatggcagtgaacacacatttctgaggacttctggaaggctacaagtcctccaccccattctgatgcaagggatacaatgaccatccccactcccagcctctcacttgatgatgagggtggagccattgagctcatgcacaaggaaggccaggacagcagccttctgctggggtggctgggcctgaaaaggctgggtgcgcaggcggtcacagagggctggctctactccatatgccataaggaagcagcgcaggatctctgacacattgtctcttgtcagtgggatctcagacaccttctcccccaagatctttagggactgtgtggaggacagcataatgggggtgagtagggaaagatgcacaaccaagttgggtgaatgtgcaagaggaaaatacatcagaagagaactatgggggttaagacagaatacgaaagaagaccacaaaagaaaaggaaaaaataaagaaaaataaaataaggagaggagtcaggaagaaaaagaaatggaaaaatataaggaaaagagaaacactaagtagttacatctcctttacttgtcctggttactttgggagggacttgcactcacctgacagtaggagggaaagccaggatcatggagtgcagccttcagcagcctgaccagcaggtcttgcacctcacccaagctgtcaccttgacacaggagtccctcctgcaggacccccaggct

SEQ ID NO: 8470 - DNA, 1354 bp, Homo sapiens
gtcagtcagacacatatcctctgtcggcttcttcatttcctccaagatcatctgctgcctctgccgttcctccaagcgcctctgtgtggccagggtcttatctgctttacaggctggcttggctttggtcacctcctccttttccttcatttttaccttctccttcttttccctcttgactttttccttcagtttttcctgctttgtctttcctttttctttctcagcctacccaaggaagagaggaaccaagactgccataaagatatcagtcactatccttccctggtcccagtcctcccaacctcacagcccagaaatctcactataaaacaagactgatgtacatgtcctgcaaaatcagtttagtggcttcgaaattatacttggcaagtttgtacatgcacctaccttggatttcttcttagcttccttctgctttaagctcttggtctcttgtttccgcttatttctggcctgtaaaccataagggaagtcatttctcctcaaactctgaaagcatctctgcttgggctaggattcaaaaacagacaagggtgctggggaggagaggtgagagatggaatgaggggttggcaatggattaattctctcaccctagagatgcccacgttatttttgaacaaacccaattctctaaatcaagtgcaagaaatttcagggtaatgaagatatgctgctacacagggagtgacggatgtgggaaatgaaaataaaagatgaagtaagttgtaggaaaaattaacctactgtttcatctctctgatgtccctcacctgcccttggatagtagtctgacactctccccgttgaaccttctgcctcatcttcttcttgcttttagcaatctttgctttatcctcctcattcaatgtttctgtgagagcagaaagaaaaatgaaacaagtgaggcaggaaggcagttctctagcatccagggcaacacatgcccgtctcaaagctggcctcccaagcagctccctgaagaatctagagtagctttttttttttttaagtatacataataaaacattgggggaaaaaatgtaggagaggcacctgctatgggggtggcacaaagaactcaaatgacatctcctgcccagaagcaccagcccctggctccaatcagactgctttagaaggtgtcctgctgatagaaaagaggccacaatggcagagtagccttggagccaatctctctcccaggatacctgacaagagcagaaacccacggactgattttagagcagaaagcagagaaaggatacagcaagccaaactgccagggaaagagggtagtagttagaagcactgattaaccaagggtgtg

SEQ ID NO: 8471 - DNA, 2367 bp, Homo sapiens
gaagaaaacatttgtcagtgagcagttaccttttactccactgaagtacaagaaagacatattttatgataaatcctagaattttgcataggtctctgggtagataataccaccaatgcctttcctttcattttcaccttgtagagatgaggtcttgctatgttgtccaggctggtcttgaactctggcctcaagcaattcttctgcctcggcctcccctcaaacttttatgatccctataatctcatgactactctttcagggagaaggctttacttgttacctaacttaatattaggaagaatcttcacattgtgggaactagaattggatgttttctgaccagtgtttcttaaatcttgctttctgatttttttctcattatcctgctctgatttttctacccttgtaaacagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaaggtaagtgacggtaggtaggacaaagaaagacctttacctgagaaaagatgagagaataagtttcatagttagggccttaagagtgggaaatctggctgggcgcagtggctcacgcctgtaatctcagcacttcgggaggccgaggcgggtggatcacctgagatcaggagtttgagaccacctggccaacatggtgaaaccccgcctctactaaaaatacaaaaattagccaggtgtgttggcacatgcctgtaatcccagctacctgggaggctgaggcaggagaatcgcttggccccaggaggcagaggttgcagtgagccgagattgtgtcgttgcactccaacctgggcaacagagcaagactccatctcaaaaaaaaagtaggaaagcaagagcaccttgctgggagctgaggggctatgggatagtgtatggtggaactaaaagaggtataggctgctatactccgacctgtgccctctgctttgaagaacttgtgagacttggaatttgtagggagaaggaggctagaagctttattggcaccaggtaaaaggtatttcttcacacaatgacatctgtagcaactttaccctttaatcctcatgattggttgggagaaaaagctacttctttttccaaccctagggaagaccccttgaagtaaccctgtttagcttggtccagggttgactgagtagattctcttgttttatgtgatgccttttttttttttaaagcctatcctgtccctttggattctagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgagtatccagattctattctatccctgtctggttccaagaaacttttctgtcccatgttgtagttagcctttccctattggcctattgtttaaatattttgcttgaactcttaacttgggtatcccttcctcccaaggtgatgtcatgaggagacgtattgctaccccagaagaagttcgtcttcccctccaacatgggtaaatgctctagtttgctacatttattgaccttgacaagtttaatgcacaactctagaaagaagggaatgcctcttttcctctgaggtgggggaggaatgggccagacaagagtagattacaggacagttatctgcagtgataatgtttcttggcatgagattcctaggttttccttcttctctcaaggtctgtcttccatcacctattcttttttcatcttgtagtgactcaattttgcccaaggagctccagctattatcttttccaaaccctagggctcacatcca

SEQ ID NO: 8472 - DNA, 1516 bp, Homo sapiens
ggaaactgagtagacaaataatgatatgctctgcctgcttccttccctccttcgcatgccaatcactacattgggctcagacgactttaacagccagtctgatcctgccacagtcagttaaaacagcctcaatgcccgctgctagaccctaaccactccgtatattttgaaagaagcctttcttgatgcagggtgtctgttggggctgtttcgggctcgcccacctgccctctccaggccagaagctctgcatgagcttgaaataatttgcactcccactcgcgagctggtgctgctgccacaaaaacaccagccacttggctctgctaattgctaatcaccaacatgcaaatcagcctccactgcagagagctggaaagacaagtttttctcacctcaaaaagccactatcccccccgagctccatttttcctttccccacccagttcaccaacccagttatacctggctgctcttcttccagctccaagctgcctaccaagccagtgccattctctgccacaactgaagtcatctccttttctgctgcctcatcaggatggataccactgcctacctcctgggagggtgcaaaggtttgaatgctagatcccaacataggagaagtctgtggggaggtgaaaaaactagggggtccattgggcatcacctcaaaattctggtcaggaaaggaatcatacagttcttgtgaatcaaagttaagccccatgggactctgggtaccgttggcccagaactcttggctcccagcccgaaggttagtgttatgacttggggatgaaggttgccggctgcccccaaggatgccgttgagtgggtattgtccccccgagaactgggagagaaggggtgggtccttgaggttgctgccaggattggcagatgggtactgtgagtagttccagagacagtcgtaggccacgctggggtgatggaggtgtgaggtgctggaggagtggggagcagagttcaaaatccctgaagtagtagtgtgagatacagtagataagccattaacattcacatccccattcaaacctggcagagaaagaaagaaaaggtcagttacagatatgtaggcaagcaactttaccaaaacaaactcaaagtaatagcactgactagaaaaagacatggtaaagggaagggggattcctcccctgctatatttagtttttgggtctctggagaacaccaagcccagaggctcctggatgtaggtttagcaactgctgctgaggctgagtagggggctagagagctctccaggcctaccatgagagccaccagcagagctggttgctgctgcttactgctggcttttttttggtttattttttgtttgtttgttttgagacggaatctcgctatgtcaccaggctggagtgcagtggtgcaatctcgacccacggcaacctctgcctccctggttcaagtgattctcctgcctcagcctcccgagtagctgggaccacaggcgcccatcaccacgccc

SEQ ID NO: 8473 - DNA, 1137 bp, Homo sapiens
ctggagagctctctagccccctactcagcctcagcagcagttgctaaacctacatccaggagcctctgggcttggtgttctccagagacccaaaaactaaatatagcaggggaggaatcccccttccctttaccatgtctttttctagtcagtgctattactttgagtttgttttggtaaagttgcttgcctacatatctgtaactgaccttttctttctttctctgccaggtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccaggtataactgggttggtgaactgggtggggaaaggaaaaatggagctcgggggggatagtggctttttgaggtgagaaaaacttgtctttccagctctctgcagtggaggctgatttgcatgttggtgattagcaattagcagagccaagtggctggtgtttttgtggcagcagcaccagctcgcgagtgggagtgcaaattatttcaagctcatgcagagcttctggcctggagagggcaggtgggcgagcccgaaacagccccaacagacaccctgcatcaagaaaggcttctttcaaaatatacggagtg

SEQ ID NO: 8474 - DNA, 3149 bp, Homo sapiens
gcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgcccggctaatttttgtatttttagtacagatggggtttcaccatgttggccaggctggtctcgaactcctgattttgggtgattccccccccacctcggccccccaaagtgctgggataacaggcatgagccactgcgcctggctagttgagtatttttaagactcggtcttatggcttaggtttaggagtctccaaaacttgtaggtttttgtatttgctattgctatgtgagggaatgctgttaggttaaggctcagtaaaatgaaaaatttatgacagttaaagtcagggaatgggattattgtttcctaagataataattttctttattgcagaaagttgggttagatcctagatgatagtttatctgatttatgtaagaaaggggaggtaagactgtggttcctcaggtaaagggatggacttgagagttgatagggagggatatataagattatcatttgctttcaacaaggtgaatagatactatcctctcttctacctttacagatttgctcccattcatgctgaggctccagagttcatggaaatgagtgttgagcaggaaattctggtgactggtatcaaggttgtcgatctgctagctccctatgccaagggtggcaaaattggtatgttattaaggggtacatattttccaaacctaatatgggaggaaaaactcatacaatgttatgagtggatattgacatctattcctcactgatgagtacgttctgactttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagaaaggatctgtggtcgtttctccgatttgggaaccttcagtatgtggcttctctactcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtaagagggaaggcttgagaggacctggttcatctggcctttcttcggatgaggctaaggatgtagacacctaagacctttttttcttttaggtgtctgcattattgggccgaatcccttctgctgtgggctatcagcctaccctggccactgacatgggtactatgcaggaaagaattaccactaccaagaagggatctatcacctctgtacaggtaagaaaaattacatagatgaagatctgatttgtataaaggcagggtgcagtggtgcatctcagctactgaggaggctgaggcaggaagattgcttgagcccaagagatcagcctggggaacaaagctgtatgtatgtagagagatgtataaaactgactgggccaggcgtggtggttcatgcctgtaataccaacactttgggaggctgaggtacgcggatcatgaggtcaggagttaagacaccaccctggccaacgtggt

SEQ ID NO: 8475 - DNA, 3149 bp, Homo sapiens; identical to SEQ ID NO: 8474

SEQ ID NO: 8476 - DNA, 3149 bp, Homo sapiens; identical to SEQ ID NO: 8474

SEQ ID NO: 8477 - DNA, 1893 bp, Homo sapiens
agtatgtttatacagtgatactttgcatcaaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttgaacttctgcattttggcagttttcattccctcacagcttctgtatttgtcataatgtagaaacactatgtattttagtgtttctttgtcagatattcaggacctgtgttgcaggcagttaaagtgctggtgatacaaagattaatatttcagatgattgctgagctcagagagctcacaggctaggggagacaaacatgagacaaaaacttgatggaaagtgcgataatagatacgcataatgtattacgatgtgtagttcttagcttcaggggggaaaacattttaaaaaaacttgtttttcttcaaaaaatttatacttcagttttgggaattaatgattcactggcttactgcccagccttgaaacgcattatacaggccggcacggtggctcccacctgcctttaatcacagcactctgggagactgaggcgggcagattgcttgagaccagcctgggcaatgtggtgaaac

SEQ ID NO: 8478 - DNA, 1290 bp, Homo sapiens
gcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtatactaggaaatctttcataatttaactctcgccgtatagcattgtgttcgtgttggtgagctatattaaaaactagattcaggagactccaaagaactgctgaaattgttcttgcctttaatttactgctttttccctctcatctctcaggtcgatgaaacaggtgtagaagttaaggacattgaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacaggaattaacaatgtaaccatatggaagcaactttttttggtgtctcaaaggagtaactgcagcttggtttgaaatttgtactgtttctatcataaataaagttatggcttcttgttggatgaattcagtcggtgactggtctcttccccgccacccccccacaccaaaaaaaaaaaaaacttaaaaaggttctagtaatttattaattactcctaaggcctccctcatttgataaggtttagtgccacagatttcccacttagaatctcagactttatacctcttttaagaagttactggccaggcgtggtggctcacgcctgtaatcctggcactttgggaggccaaggagggggcagatcacgaggtcagga

SEQ ID NO: 8479 - DNA, 1206 bp, Homo sapiens
agggaggctgaggcaggagaatggcgtgaacccgggaggcggagcttgcagtgagccgagatcgcgccactgcactccagcctgggcaacagagcgagactctgtctcaaaaaaaaaaaaaaaaagatactggtgttatttctaaaacatccaaaaagttcacgtggagcatcctttttacttcatcttaataacctaaatcaatatgctataggtctcacatttccggagaagatcctcttcctggaatggacgcggccttctgcccacaagagcggtggccctagtgcccgaacgcgtgggcagatcgcaaactgctgcgtctcccgcagcccccgcgcgcaccaagtgggaactacaattcccggcggccccggcggactgcgggccgccgggtcagacagccgacctcggccataagcgcctgcgcagtcgcggggccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggaggtgatggaggcgaggaatgggttcgggagcggagtgtgaggaggttggaggcggggtgtccttagaatgacaatatgaagcgccttctgtgcaccaggctttgtgccgcgcgccttcatttgctctctcgagcccgccccaccacttcataggtgtaaatgggccgagagaggatataataagccagcctgcggccacgctgtaaaaaaaaaaaaaaaaaaaaaaaaaacagagccgccgctcctacctctgcgtggtcaggctcacattaggtgccccgtttacctgcagcggtgcccagggggttactggggcgtagcgtgaagctgctgaggcatggtttgcatcaggagcggaagagcctctctcagaggaagagaaatactttcttccttgcagctgaatttattagtgcgaatcgaggagagaggggtggcattacatatttaaaatatttatgcatctgtttcatcttttgtaccgttccctagcaaatacggaatggtaactgctttcaaattagggactaggtcatgtggattttgttttgtttttcttttacatctaccacggtgttgagcatagggggctcattaaaa

SEQ ID NO: 8480 - DNA, 2449 bp, Homo sapiens
agaaccaggggtataactaagggaagacatgtcaagcccttaagcaaattcttcttctccagattgtctctagcataataaacccagggaacactttaggccatgggtgtatgttctataaagttcgggacagttaaattccaggcctttcatcccccttccttcctgtgatggagtagattggggacagggttgaggggaacaagtgacatgaatgacctatttgcacagtttggaagcctcctgtctttatttatattgagatgtcagacaaaccaaagctccatccttgttggacctgctgcttctccccagccctgaactgataaagcctcagagttggagtgcctggctctctggtggggtgaccattagatgaagggacttgtacagtggccagtttaaaggtccacctttgaccatctaaacccaccttgttcagtgtcctctgaggacatcctcatcaggaaagcagtgttgagactcttcattgctgactggcttctccctttcttactcacactgaccattagaatttaagaaggaaatgtgtaacagactacagtcaagtgtctgctacattttcaagcatgagcaatccctcccagactgttggtgaggactgatttttgaaatgctggtgtgagagaggtggtaattacaggaaccagccgagtggctgagagcagataaatgtgctggagaaacctttttccttaacagagggcatcatggatgctgggtggtctgtgtacttaacctgaaactgtgaagttttccctttttgccagtaaaccaaaaagcagatccttgaaacttggcccttgaaacacgaaacagaaaactgcatcccctgatcccccgggggctgatcagattgatcagggtggctcagttggtcccagtcagatacgtcataggatcagtagctcatgagatttgttgaccaaaccctctccctgttggtgacccctgtattcacacctgaacttcccgtttccccccaccccaccaaagtcatgtctgcttcctctgcctccagctcaccctcttctgaatggttttgcttgaaacactatattgtggcagagggcaccctgggatacctggtagaaggtattcattttattttgcatttttaattgttttgactttctgttcatttgattttgttgctccctctctcctggaacctagtttactactctcttctgtgttactctgaagttctgtttaagccttgaacatcctcttctcccattttcttggtatgtactcaggaccagctacatcatttgtggagccctcttattcataaattattaaaaatttcaaggtggtggtcatagagcattaaaccaaatatgaggccattcccaacttgttttccgaggggaaaatggtaatacttgtgtggcacccggggttaaacagcagaggctccatgtggccagaggcagagattagtatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccaggagatgggtaaaagtttttttttatattctgcttttctgatctgtgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactcttttccctaaatcctgcaccaaatgagtcaggaggcagggtgcacagcattagtttcaatgtggttatgcatcataagcttaacatcagaatgaaaatgaaactcgattttgatgtttctttaaaacccttcccctgtccaatccactcgccgcccccaccttgaatagctaaagtctcttatgaaacagagaagagttgttgacgtctaactccttccattaaattaataagtactgacctcctaatatttaagtgtttactatctattgctgtaaagttttgtatattttgtaaacttttttccccaaatagtagatgtctaaaatcattgtacatctgattcttttatattccattgttcagcacaaagtgtggtttttatttagaataaaaaaagaaatttgaaatgagagttctcttcctacctactatgaatatgctcatacctggagttcagaatatctgggctcatcaccctttcagcagcacatttctgcccagcagatgccagaattctttcaggtagcacattt

SEQ ID NO: 8481 - DNA, 1181 bp, Homo sapiens
aagcgcggccaggccgagggctgcccctggccgaagcccgaccttcggcccggcatttatctcgctcttgctggggtccctcttgcccgctcccttcggccggacccatcctccccgcccgcgcgccgaccccggccggccccgccgcccctcgcttggccccttattcagccccatgcccccaacaggctcacccgggtgagccccgcgctgtttgtggagggactgaggcgctcgttgcctccagagggagcgccccagccgatgcagcgcccttccctcccagatgcgactccggaggggagaccgcggcgcccggggattgttggggtgtccttggaagttcccagcttccccctctcccaccctctcctctggctgcccagtgctccgacccgcccatcgttcaggggtggccaccagggcccgggagatgcttggccggtaccccacaatacttagacgcttcctgggccccagaaaaagttgggagttgttagaatctggagagatggagaaaggggctgtgttgggcagagttgtgagactgaacagggatgcaagtagctcttcttccttagtcgtgcaggagtcagaaagggcagaaagtggtagtgaacaagcctctaggagtcttacctgtataattagaagtctttcttgcggcatcaagtaaatctgttagtgcagggacaacaaaatataaaccccgaaaagggtggcgaaaaagaatacaacatattaaagtaatattaaatactaccacagttgtgttctacttttcttactgtgcattctgagtgttttaacttcacagaatacagggactgtgataaagcaatatctggaggggctctgggttatcgaaaggccagagagcgggtatgtagtataggcagagagagatggggattcaagaacgtgagatttatttggagattattgagaggttgaagacacagcaatgacaaagctaaaaaacggaaccaccttatatgttcctcagtagctagtggagctttgatagttgtgttcaagcatgtgcatggtatttggcatcatgagggaaaagaatatgctcaatgaattaggaaagcttgtatttgggaggaaattaataggagaaaaatttgatccagtggctctggtaatgaagtataagattgtgtccaagggaatgc

SEQ ID NO: 8482 - DNA, 1154 bp, Homo sapiens
tgtccctccttcctcacagtgcaagaggttccgggatcagctgtccccgaagcaggtagagatcctgagggaaaagctctgtgccagtgaactgttcaagggcaagaaggcttcatatccccagaggtgagggcctcccagaccctgcacagccagttccatcacgcagcagttctcaaacttgagcgtgccttagaatcacctggcaggattgtcacccccaggtgctgtgtccctcctcagagtctctgatccagcaggtcttggggtgaggaccaaaatttgcctttctaacaactccccaggtggtgctgatgtcttggtcctggactgtgctctgtggacactgacagaggatacgtggatgtgggggaagggcccgggaggactaggatgggaactctgggggtggggaagaggcctctgggccttgtcgcgctgcacacctcccatgtgttctcagtgtccccattccattctgtggtgactacattgggctgcaagggaaccccaagctgcagaagctgaaaggcggggaggaggggcctgttctgatggcagaggccgtgaagaaggtcaatcgtggcaatggcaaggtaagggcctgcaggctgaactcctcccgcagctagtgcagagctgtgggctggcatctggagagcagatggcaggctgtgtttgcgccctgccaggtggagtgggggcaattaatcctgcctttcctcacccttgcctgttccgtccctagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgaggtatcagagctgggtggggcaagccttggactggagaaggtggtatgcatcccagggctggggcaggctggaggtgatggggaccagacctttcgctctgggcctttgatgtccctcaggtgctcctgaagagaaaaaatgaatccctttcctgctatttttccctcttcctaagatgtcatcggtgggctccaagggggacttcctgctggtcagcgagcatgtgattgaactgctgaccaaaatgtaccgg

SEQ ID NO: 8483 - DNA, 3438 bp, Homo sapiens
gaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagatatattgtggtctttcttaatgaacataatattttcttgtttggatttcttgttttcaggtaatcagcaatttactcctcagtttcatctttctaatgagatggttttgcatgccactgatttccctttttttcttagccaccccttcctgtcccgagtctgtactggtctactttcatccttggactggatgatttcccaggatgcaa

SEQ ID NO: 8484 - DNA, 1247 bp, Homo sapiens
agatgccccccagcctgggccagatgagcctgccctttgaccagcctcacccccagtgagtgacaaagcccctcctgaccccatgtgcctcttctttcctggccttgccccgctctccttatttccattgctggttcctggcaggggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctagga

SEQ ID NO: 8485 - DNA, 1174 bp, Homo sapiens
ccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggaga

SEQ ID NO: 8486 - DNA, 1207 bp, Homo sapiens
ggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtg

SEQ ID NO: 8487 - DNA, 1208 bp, Homo sapiens
ctctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctgg

SEQ ID NO: 8488 - DNA, 4037 bp, Homo sapiens
acacacacattcatgtcacacccgcccctcagggctcatccatgccctcggtgcccctaccctcaccctggtcactctcctcacttggagccacacagacagccgagagcctgggtgcacgtgccctcagtgggcacgagtacatgccccagcgccccccaccacagacctgcagctttcccaggtgtctcccatgcgccctggggctcactactgcacccgtgatctcagggccctcagactcgaatctctcagaaacactcctcaaagcccacggtgccctgcctaaaagcacacacatcctcaacggcacacctgccgaaaaccccatgcacctggccctcccacagcagccatccccatgccctccccactggctgcaagccgctgtgcctgccgtgactgagcagaggcttgggagctccatgaagtcagtgaatgggtgggtgcactctgggtgcatgcacagcagagaacactctccagccctgcgcccaccctgtccctgctcaggtgaactctctccatgccgaatcaacaacggtggctgccaggacctgtgtctgctcactcaccagggccatgtcaactgctcatgccgagggggccgaatcctccaggatgacctcacctgccgaggtgagagaggcgggggggaggggctggcggggaacccaagcacacaccagggatggtgaccatctcccctacatgctccagcccagccccccaaagccttttgccaagaagacgctgatgatgacctcagctccccgggggaggaggcgtgggcactggggcccacagcgctggctcagaaagctccctccacctccctccccagcggtgaattcctcttgccgagcacaagatgagtttgagtgtgccaatggcgagtgcatcaacttcagcctgacctgcgacggcgtcccccactgcaaggacaagtccgatgagaagccatcctactgcagtaaggagccccctgcagcccctgcctcttccaggcccagagcccaggtcctcctcccccaggcccctgcaggatggagcaggatcaggacccagcttcctgaccatgagttttgggagctcatgaagggcagaaccactgttagcctggactgggcctttgggtttgggggtggccagctggacacgtgcatgacgtctcagggaggcagccctttccctgtgcctgtggctgacacgcagcctactcctccatttgcagactcccgccgctgcaagaagactttccggcagtgcagcaatgggcgctgtgtgtccaacatgctgtggtgcaacggggccgacgactgtggggatggctctgacgagatcccttgcaacagtgagtgaggcgcactggcataacccatctgtacctcagttcctgccccacccctccctggccaagctttgtccctgggccccgtggtgtctggttcaaggcactctgtgacaggccagggcaggtgctgtgggccaggagctctgtcctgcgtccttctggcccccacagagaaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagatgaactgcagtgagtgacgccctttgctggcacctcctgggctcctccccatcgctcactgcatctcccgccttcaggccctcctgcacctgcccacattcctctctgccttccctcatccccgctgacagcctccatctccctgaggccctgtccccatcccgctcctgctcctgggctctcgtggggttccgagagggggcagtgagcagatggtgcagacagtgccccaccagaagggcaccgttcaacttttggaaacacatgaaggctccatagggctggcagctgccccagtcgggggtgatccagggggaaccaggtatcaccctcacccctgcccccaccaggtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgggcgggggcaggtgtgtggtgggtggtggcctgcggtgagcagggccctcacacctgcctcgccccccaggtgtgaaacgccccagatgccctctgaattacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaaggtgggccccagacctggctcccctctgccccctccccagactgcctgagaccccgctgacctgccgcctccgcccctccgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagac

SEQ ID NO: 8489 - DNA, 4037 bp, Homo sapiens; identical to SEQ ID NO: 8488

SEQ ID NO: 8490 - DNA, 1161 bp, Homo sapiens
ggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggt

SEQ ID NO: 8491 - DNA, 1099 bp, Homo sapiens
tgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactcc

SEQ ID NO: 8492 - DNA, 1229 bp, Homo sapiens
ggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagc

SEQ ID NO: 8493 - DNA, 2075 bp, Homo sapiens
ctcccactaggtgaacaagatctgtcttgggatttggagcaatttcctaaacaaggaaaggaagggaaacttgacttcctgagatgataagaaggaagaatctatttgagccagcctctgagtgggaagggaactatggaacatatttcagattgatacattattgttaaagaacattagcaaaagccacattttcttcatagcagtagcaccttgtgagagaactgaggtataggttcttagctcagaaacccaggattctgattccctgtcccttctttcctgtatctctgggctaggagaatagaaaggttcatttgtttttctcctagttgccctgatcagagctgggatggtggggaggggaagaaagggctaagagagaaaggccaggcttttgaagacattgtatacagacttagtcagctggacacttctctgctgggctgctgtcaagtccttcctgtcctattcctctcacaaccatgtcctctctcctccccttccagtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggacatcagtcactgtttctctgttgccgccctggtatgggtaaagggttggaggccctgggtaggtatagccctacagctgttggaggtgtttgtcgtgggttgggatggctttctctagcatacgcacactattttaacaccattccctctgtctcatcctcttccctgtacacggttctgatagatggctagatctctaatgggaccatggctttg

SEQ ID NO: 8494 - DNA, 2284 bp, Homo sapiens
atgtactttctgggtctggcatagtgaaactatgtggatttatcttctccagaacaaccagaggtcactgccttatctatagccattaccagaaaagcctgcacgtgtctgcagccctggcctgtggcccagacctggacccgtaccatgcctagacatttgagcaatctgacctgggcatttggttatagccagcgttgacagaatggagtagttttctgccaagcataccaaagtacccctcaccaggtgaaggccaggggagcactggcatctggggctcatatcccttccactcaaacttctactggtttgagaagatggagtcagaagccacatcagcagccatctcaggttcctggcaagacgtagcttgagtgaccctgaggcaatgggtggatttatttgctgctttcccactcagggctagttggaaggcaaaaatacagttggaatttgtaaccaactgctttcttcctgcccttcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggtgagtgcagcactcagccttgtcttggcaaggagatgaccgtattcttcccggggcgcaatgtttgctattgactgagcagcctcttttacatgtcttttcctgggtactttctggggagaaacacaggaagtagacagcatcctcttttaaggaacctaatatataaggtggcaggtgggatacacacttgaaaatgctcagagaatacttaaatcaatatgccagaaatggatattaaaataacataaatgggccaggcatggtggcgcacaccggtaatcccagcactttgggaggacaaggcgggaggatcacttgaggtcaggagtttgagaccaacgtggtgataccccgtctctactgaaaataaaaaaattagccaggcgtgatggtgggcacctgtaatcccagctactcagaaggctgaggcaggagaattgcttgaacccaggaggtgtaggttgcagtgagccaagattgcaccactgcactccagcctgtctgggtgatagagcaagactccatctcaaaataaataaataaataaataaataaataaataaataaataaataaaatagcataaatgaattaaggactgaggttgcagtttgaaggaagagtctgactttggcagagttcagcaagagaaacttatttcctgagagaggtgaattttaagccaagccataggaatatccagagggtaatgtttgatgtttatgtgacgtgtgctcctcttttccacaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtagggggttagattagtgctggctgctatggaattcacctttcacatcccattcccaattgcagagattgaaagagtaacaacaggcagaggaccagtgtagatgatccaattctgggagttaactcttcctttaacatccctgtataggccttggacacttgcccctctctagtgctgtccatgcttaactttctttagccttctttacatacttagtacttacaaccaagtaggtaaaaagagctggagaaaataagttcactgaactttctaatgaccaaagagtttaacctaatatcagtaccaagtctgagggctgggaatgtgggattttgtaagaaacggtatggtcttagaaaaggaaccactagatttggtttcagaagttccagtctcaccactaactagctttgtgatgttcaacaagttacttaaactcagaagtagacctcacttcctagtctgtaaaatggggttaatcacacataagatgggaattttatctgctttctgccttagctgtcacaagcagtataaaaatgagaatgtagtttaaaaactttaaagtgctctgaaatgtaatatttatcaataataggtaacacttaatggtacttaatatgtaccaggcattgctataaatgctttacatgtcttatatttgtttaacctttccagcaacattaatgagggaaaaaaatacccaacgttagatcatatttc

SEQ ID NO: 8495 - DNA, 1127 bp, Homo sapiens
caatttaccaatagaaaaactagaaaatactgagaacctgagtatttaacactagaattcagctctaaccccctttccaaagggtttctctcttattgactactacacttgataaggactgtctgactaacttggatttgagatctcactcctactactgtagttgtcctttccctgttgtcctttctaaagctagccaaaccttgtggaaattggggtagtgagatttcccattcttggggtagaggattttccatctctctcaagtctttttttcttaggctgtcctgccctgtggttcatctgaaaaccccaggcagagaggaccttgcattgttggtggtagtagagatagatagagtcccctgcattaaaaacaaaaaacaaaaaatcaggattcctgttccacagtctacacttcggggtcatagatcatcccaggataactgtaagaaataggagttttaaaccaactcctatgtgtgaattaatgcacagtgctttacagtcaccagagtatactttatctgattcagttctctcaacatcctaatttggtcagctggattacatgtaagaaaacaaaagcagagagatttaagtggctagcccaagtttacatggctaatagaagcaaaaatggagctgattcttagtttagtgtcctcttcgctacaccacaccagctctctacagatgtcaccccttcctctcttagtagtgttacatttggagccctaatccagattcactggttagaatgatgctcttattagggctatggaccatcagactacatcaaactgtgcagataatagcttgaaggatctactgagtaggtgcagccctttcctctccagaccttttttttttatttccctgagatggagtttcgctcttgttgcccaggctggagtgcaatggcatgatctcggctcaccgcaacctccgcctcccaggttcaagcaattctcctgcctcagcctcccgagtagctgggattacaggcatgcaccaccacacctggctaattttgtgtttttagtagagacggggtttctccatgttgaggctggtctcaaactcctgacctcaggtgatccacccacctcagcctcccaaagtcc

SEQ ID NO: 8496 - DNA, 1187 bp, Homo sapiens
taatcccagctactcgggaggctgaggcaggagaatcacttgaaccccagtggcagaggttggagtgagccaagatcacgccatgcactccagcttgggcaatacagtgagactccatctcaaaaaacaaacaaaaaaaatttttttaagtattttgcagggaaggggattggggttggggttggttatataattaattcctactctttctgagccttggagatagattctagagagactgatgtttcatgaagtctggccctagcctctcttcacttcactgataggacagatataactatggaggaagagaagttatagatgtataaagtacagaccctgaagatttcattaaaacctgcatgtgactttttggattccttactccagaaattccctgagtgtgagttgtgtaatttaggagagctgtacctaataggtctgcttcctaacaaaacggtctttgtcctcctttcctttcacatttctctccaaatctcagccctgaacagaggttctcagaacatataaaggatgagaagaatacagaatttcaacagaggttcattctcaagagagatgatgccagtatggaccgagatgataaccaggtgaagaatggaaaggggtgggcctatatagagagtttgcagtaagagaaactgggaagggagaagaatttttgtgggatggagaaaactcaaaatatcttagtacggagaaatgtattgagctatacggagttggctttggcttaatgttgagaactgtttatttgttgaactggatgccaccctcttagccctagagagacatggtgctgaggtttgctaggtgatctcatttggcctggaactccttgggtctgccactgacttctaacaccacatcatttggaataaagcaaggttgatccctgcctcagccttgatccaactgttggtttcattcttttttttcctttaatagttagggatttctttgggaaccacaaaaagctactttgtcccacttcaactcttatcctagcttagggctagccttgaactggcaaagttgtgatctaatttacccaattataaaggtgtttctgatccctttctgcaaactccttaatctttttccaactccttccaccaaggtgagtgagttaatttgacatttgatgctgggaacctcagatagat

SEQ ID NO: 8497 - DNA, 1167 bp, Homo sapiens
cgaagctttaggaagaaattgttatatatactcttaggtgtgagcataacagcccaacccattttttttttttttggattgagtatctgggcttccagtcgcttttcatgcaattccattttaataccgctgatttctagagggctgcagaggtcagtttgaaaaactcagtaaactagagcctaggaaaattaagggtttacctatctgtcaatgtgtgtttaggtaacatatgtggaaaagtacctttaaaaatatgctggtttattttctgtctttattttctcttctgttctgtgctttcatttactctgaattctttgtgtgaagtgaaaagagtaataatgtctgcttctcagcttacattaggtattcttatttttctatgatagttcaattatattaatatttattacagccataaatgtttcagaccaacacaatctatttttggggggtggggtgtggtaggaggagaaaaaggaagataatcctagggcaaatggagagaattctagaagaataacctatttagatgtttgccagagacaggagctataagggttaagggaaattccaccacatccttgcatcttgatattgcagcaaatttgtggataatttcttgctagcttttcaggaaacccctgtggtggacaaccctcattaatcgttgctgggagactgctctgacgtcactgggagcagttccctgtctgcaactaggacaggaatagcctttgagggggaagaaaactgctgtgaaattaaaagatgacggttttgtttacttggttttcctttcatttgagggtagataagatagacctaaagtctttcttaaatgtttgtcattaccaagggaaaaattgccaaaagttctttttatttcaactgggagtgccttcttttgaaatcttttattttctaaccatcaaggttttggaagaggtcaaggaaaaagaaaagctattgaaagatgttagagaagtaagatttctgtttctttttatccccttttctccctactttttttgttttttgtttttggaagaaggaaagatcaagaacaacttttataaatggttgtttttagcatcaccccgtttgggataattaaaaatgtgatatatatgttggaaggacactactgtgcctaaaagttac

SEQ ID NO: 8498 - DNA, 1167 bp, Homo sapiens
gccccctagggaaaaccacacttattccgacccttacatatcccccgggaaaccgcccgccttctccctctactggaacgtaaagacctatcctagaagaccccagctctccagacccctaaaaccctcagtccccaggctctacggggtcccctttccgtaatcctgtcccgaaagctagctgcccagtgctgattgtttcggggtcatgggacctgaaagaggattcagagcggggagcaagggcaggcagggtggtctgagccagaggaggggcctcgatccccagctcccgtttgggcggggtgccaacggggatacacaggctggcagtggccagtggtcccgcccagccccggtaggggtctccctgcggctggctcccgctgccccggtggtcctgaggtcagagggtcaagacaaggtctccccggctcctcctgagctccttgcccacagcccttgggactcaggagtccaaattgcatggggtcattctagggccttcactagaccttggacagcccccccccgccccagcccccttccaagtccagaagacactcctttcccctaaagcacaagcatccactggcacatctgtcacaagacaggtcaaaggttcaagcctggctggcccctagtggctctgttgcctcccacacacccgtccccaccccacctggagctccctcctttgcagtccccacctttcagaaacactgacatcttcctaccccacgcgcagacacacacctggggttacctctctacaacgcagacctccagctagccatccctccagcctcttaaacttaaccgcatgaaagtaagatatttctaatatatgggagaggcggagacaaagacccacggttccctgagacagagatacacagactgacagaagaaaaaaagggaagaaaaagaagatacagagaaagacacaagtgaaaaatctggagtttctaatgtctcaccccaggctctcccacccctattttgcctctatgtcccgggtctgggatgagtccctaagaagctgagcatcccctcaggccccctcccccactgctcccaggtggtcccccgcctgcccccccttctcacctctgtctgggcgctgggctcgggatgcgcggtccagggctggagtctgggctgggg

SEQ ID NO: 8499 - DNA, 1229 bp, Homo sapiens
attcttctaagcaaaggttttaaaaactcatttttaaagaatgagttaagggccgggcatggtggctcacacctgtaatcccagcactttgggagaccagaggtgggtggatcacctgaggtcaggagttcaagaccagcctggccaacatggtgaaatcccatctttactaaaaatacaaaaattagccgggcatggcagtgcatgcctgtaatcccagctactccggaggctgaagcaggagaatcgcttgaacccagcaggcggaggttgcagtgagccgattgcgccactgccttccagcctgggcaaaaagagtgagacccgtctcagaaaaaaaggaatgagttaaaatttgctagtactttggattgcagggtgtgagagaagaggaatgaaggatgataccaaggtttttagcttaagcaactagagttgtcatctgagatggggatgaccttggaaggggaaaatcagcaagagtttgcctttgcacatagtcttaggtgcctattagacattgaaaaagaaatggcaagtaggcagtagacagcagagtctgaagttctggaagaggtccagactggaaatgtacatttggaggatgtcagccctgtgggaatggagttaggaaaatgctatgatttgttcccttccctgtagtttagtttttaccctggcagatttgaggcctgctttggatttagagaaagctgagttggccaggactttactattatgtaaccaggactacaaatgtcagcaactaaaaataaagaaagtcaggccctcttctgcccttcgaaatggctacagggaccaagtatgcataccccacaagaccagaagtaaggaaggaccagtaggaggctggaggtaaaagaaaaataagggcccagcacggtagctcatgcctataatcccagcactttgggaagcgatggatcacaaggttaagagatggagaccatcctggccaacatagtgaaaccctatctctgctaaaaacacaaaaattagctgggcgtggtggcacgcgcctgtagtcccagctactcgggaggccgaggcagaagaatcacttgaaccgaggaggcagaggttgcagtgagccgagatcgcaccactgcacttcagcctggcaacagagcaagacttggtctcaaaaaaaaaaaaagaaagaaaaaaagaaaaagaaaagtaagttgcctctcccccttccaaaaatg

SEQ ID NO: 8500 - DNA, 2611 bp, Homo sapiens
atggagggaggccttgcccttcatatgcctaagaattgggctagactttcttggtcccagggagctgaggttctgaccctctggtccctagggactgggcttggaaaggatggttgtagactaagccagcagatccccgagatctttataggtgcttgcctcacattgttaaggatctttcttttgagagggtgctgggctgtgctgctctttagagttgggcagactcctgacagtcccatctctctacttgcgttgcaggtgtgggctaagctggtggccccggctttagactggaccccacaatgtttgcagagatgttcaggtagctgtggtgatacggcagaggactcctcagtctccctcccagctgaggggttccccttgctcctctggggcttcccctgagttttcttgggtctccccacaacctttgccttcctggagtcctctctcaggtacttcgctcagtttaatcctcctagtgcctacatggatgtctgtgttatcaggcacgcgggagctgattacacacaatgaatgggggcaatgagagcagtggagcagacagagctgggggccctgtggccacatctgtccccatcggctggcagcgctgtgtgcgagagggtgctgtgctctacatcaggtacggatcttcacaggtccccaagctctgccactccagttgcccaggttttctttcttccgtttcttctctcagctcagctctctggtacccgattgctctcctctcttccccttccttcctcagcctttttgctttctgtagctctgggcctttgaatccattctccctttttctgtgtcttcccacattccttatcctctgttcttctaggaggatctgtaacttaagcactgtgctttaggagtattgcctgattcgctgccagctaaccccatgtcctctgaccctgtcctctcgcagtccaagtggcacagagctgtcttccttggagcaaacccggagctacctcctcagcgatgggacctgcaagtgcggtctggagtgtccacttaatgtccccaaggtcagagtggtgaggggcgcctgagagtacagagataagctaaaagtcttaatgcaaatcactgactgaggtagcccttctcacaggttccagcccctcagggtccctgtccttgctttccaccttacaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggtgagtcttctgccactttacagaagaccgaggaaaacctaagggcttggaaggctggtggtgggaggagttccttgagagggagcaaagagaaaggggagtgggtggggagctgcatgttgaaaggagggcacagggaggttgggaacttgtgggagatgggactagagaagacaaaagagtttttggaaggggagccacaggctgacccttcatttttcatttattgcaggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagc

SEQ ID NO: 8501 - DNA, 1194 bp, Homo sapiens
gtgtgccaggtatgtgagtattgtggagcccttcctcatcctggctggaaagaggcagccaaggcatttaggggaatgttcagagagctctttgagggttttctgggttgggggcagggaggttggcttctttggatgatgggagaaagggcctcccttgagctgaatttctctcctcttttacaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccaggtgaggatgggggtgagtaggtgggacagaacaagatgtagaataagagatgggagctgggaatcaaaagctttcagtttcattcctgagctcttccttggggcctttggggaggccttagttcttggctgggggtaggatgactgcaagaattgggtctgtatttaataagcatggcctatctcacttgaggcttcagtcagatagtggatgtgaaagcactataaatctgttgagtattttacacgcgtaagtgttagaatcattcttttttcttagccctgtgtcctgagtgccccccaacctggaccacctacctccagtgtcaccacggcaactactgacc

SEQ ID NO: 8502 - DNA, 1435 bp, Homo sapiens
ctaatgtccaaatagtggcttggttttcaaaagggcagattcttatttgaatatgaataaggatattatgcctttactatccaaatgtagaaagtttcccacccaaacttctgaaattcacctggtgcttgggagctgttcctgatcatctgtgccccttattgcagccctacccggaacagcaatagctcccgccaggacattaccttggaacccagccctacagcccgagtaagtgtgtgtttgggtggatgggtggatgggtagggtgtaagggatgaggcggcaggaggaaaggagggttagagggagtggggagaaaagaagacttcctgatacctagcaattgaccacttctatcaacttcccctctgatattaggcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctggctctggctctgtactcattttttatttagttctttggtaagaacaggttacaatttaaatccat

SEQ ID NO: 8503 - DNA, 1162 bp, Homo sapiens
tactctaagggtagcttgaaaattggtgctataaacatcccccctctgtggcccacaaattgtgcttccatttcttgtcttctctctcagagaattccttcaggtcctcatccagttaagcaactggacctgacaaagagtaaaacctctctaccactttgtaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagctggtcatgctggccgctccggttggaccacgttgcataatcctcagtcgcatcatcacaacgtctctgagcgttttgatggggggagaaggggcagtgtagtgtgtatgggaggagaggcccagagggctctctttgcccccttacccccttttttatatcccagaggaaagtcgggggaacctggctacaccttgaaatgaggctatgtgtttcaaacct

SEQ ID NO: 8504 - DNA, 1134 bp, Homo sapiens
gatggggagctctatccttgagggaacctatgccctcccccagcccccactcccatgacaatcctggcgtgtaccttccttttgtgctgccctgcctgcttctcaaggtgagggttgggacacaggaccttgagtactaaggtcctgagtcactctcaatccttgtgccagggtggtggtgtacggggcctaattggaggatagccttcaccttctttggcaatagtgattgccaaggacctgcccgcctctagatttagggtaacatcgttgctatcacttacactcaccgtttactgtcaggtcccaattgtttccgctgtcatccctaccccttgagacatgggaactgacatactgttgactcacggggcaggtggaggagaaaggacagaaccctgacatcacaccccgccttctctgttagcttattcaaatggagtgggggaaggggtgttgttggatgctgggtagtgaggttgggtggtcactgcttctacctgcaggccaggaatgagccagatgtttatgaaactagcgacctacctgaggatgatcaagcggagttcgatgcggtaagaatgtgtgctgccacagactcctccggactctgacctttctcccctagacaggtccttccctttctcgggggagctacagcaataagcgggtatgccaaccccagcctgggtggtatataggttgcagggcttgcaaagaccttgctgggcttgcagccaccaatgagcaatggcaggagggagagtcaagtcagcggaattacagctaacaacatctgtttgcaaagccctgattcttgggccttttaaataaaattgaaatatctcaaaacaggtttggagctagtgacttaggcccctgggttctaacccatggaaatgaatcatgaagcctgggcacttgtaataaactgctaccaagaactagactttgaaatatggagaaatactttttccatatgaatatccagtatccattgggcaaggaattaagaaagtgattccaagattttagagcaaaacaaatttgaggaagaatgtaaatatttcacatcagcggatgtgagactgtggttgcatttttagatccgagaattctgaggatggagtaatt

SEQ ID NO: 8505 - DNA, 1187 bp, Homo sapiens
tccagcctgcgcaacaagagtgaaactccatctcaaaaaaaaaaaaaggaatcatgtaatatgtggcaggggttaggggcaatgtggtgtttgacaagacagtttaggggaacagaggaagggccttccccaatcccagccaagcatctctgttactccatcttcttccctgttccttccttcctccgtggactgagccctggaacgaggtggtgacagccctctccatgtgcagctgctcatacacactcatctcttactgccctggtaggtcagcaagactggagcagagggagccgtgctggacgaggcaaagaatatcaacaagtcactgtcagctctgggcaatgtgatctccgcactggctgagggcactgtgagtgatccttaggtcccctcacccctcaagccacaccccatctcctcccccacctgctaatgccaccatatgatcatgccccaattcatgggttgtctgatcccggggtggcaccactatcctttctgattccctgttgaattttatttgtttatttctgattcctggtctccttcctcccccagaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcggtcagtggcagggtccccagagggatccctggtacccagcttcccatcccagcctctgcggctctctctcctcagggtcacccaagtctcatgttgctctcatttctttgttcctcttctcctcacccagggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggttagagagggataggtgggagtgaggggcagtgggaagaggaggaggatgtttgggagccaactctgtttgggtggtgtttctggccaggccaatctcctagaagaggggctgtgtttctggacaggtgcagtagagcagtcatgggggaagggaggggcctgactacctacctcccatactcccaaaaggtag

SEQ ID NO: 8506 - DNA, 1817 bp, Homo sapiens
agtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggtgagagaaccgggacaatttaagggtggagaggggatttttcctggaggacagagaccagagtgctgggggagagcctgattagcttttcagaacaaaactgactgcttcctggagaaagggaattggaactaaacctactctgaattgttggtctctctcccaggagccccccagaaggaggtctacttcatgggcctcattgatatccttacacagtatgatgctaagaagaaagcagctcatgcagccaaaactgtcaagcatggggtgagagttcgcaaaagcctttcctttcctgtcttgactattctttgggaatagagtctcttgtgccagagcaatggggtggcaaaagaatggaggtggtctggggtagattgggtgggggtgatggggacgggtgctagggtggcctgacatattgttccgtatctcctctcacaggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactcc

SEQ ID NO: 8507 - DNA, 1224 bp, Homo sapiens
ggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggtaagaagaccatggcctgcccttaccctttggctttccccaagctctgacctaggaaaaccgggtgagggtgagtgtgcttgttagatgtgagacagtcttgctgtcttccactgtgccctcctactcagtgccctggacctaggaggtccccgtgaggcccagcctttccatccctgtgatcccaaggcacacgtgaaaatcagatatgagctaggaaaaaaaaaagcaaatcagatatgagaggaaggaattgcatattatttccttgatgaacacaaatactgtgctgacatcttggcagaggtaaattctgtggaggtggtggcttaggggaagggaggcacaataggaagggatctgaccaacccaacagagccaggagcatcactctgtaaaaacaggagtagtcaaggcctataggtgtcttcctgctggacaaagagtaatgtgcaattctggctgcagaggggtgaagaagctgcacagaagagtga

SEQ ID NO: 8508 - DNA, 1228 bp, Homo sapiens
tggctcctcccctttgttccatttccactgagggacccaccaacccctcgctcacggagcctcctaactggagagaaccacttccaaactgttcagccatctcagtttctcctacattcaacctggtcctggtgtgcccagcttagcctacaaaaataagcagaactgggctaaattatcttggatttggaggtgtcctcccttaggggaggtggggaggtgtctgagccacctagaatgagggtgagcatggggataatagcaagttcaaacagctaacaaccctcaccctcatttctctttgctcccaggtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactctttatgccacacccgttcttttccagggactgggtgggggtggggtggggagagggacctgctggaaaggggagaggggatgatggggtgatccctgcgtgcactcccagtccctctgcctcctgaggacctggggaaacgggatgcaccagcgggctctgtagtaacactgagaaaccctgggtcacttcga

SEQ ID NO: 8509 - DNA, 1220 bp, Homo sapiens
acctctaccctctcccaccaggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaatccatcaaccttttttgtggggtgggggttccagcagggagaaggctcagtgttcttttcagatcatgctctgatcctgttctttgctccccattccccaggtactataaacgggggctggggtatgcaggaagagaccagggtagctaaacaaagcctggcctggcaaggattgaaagaaacacttgcaatgctgtcatcttccttttctcatctgtctgtttctgttccttcccttttgcaccaagtctttccctattgtttccccctttataccctgaaagccaaaatgcacaccatggagctccccccggcggggatcttccttctgctgtggtctctcccatatcatgctccagattccatttgtcatccacacccctacccacctgtcctttcaacattttccaaaaagacctccacct

SEQ ID NO: 8510 - DNA, 1147 bp, Homo sapiens
atgacagggtttcaccatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgagtaagtgaccaacatgggagaaaaagattttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatctcagctacttgggaggctgagataggagaatcacttcaactcaggaggcggaggttgcagtgagctgagatcataccattgcactccagcctgggtgatagagcgagactccgtctcaaaaaaaaaaaaaaagaaaaaagaagaaagctcatcccag

SEQ ID NO: 8511 - DNA, 2657 bp, Homo sapiens
cagcatcacctctggtaccccaactcccaccccctccccaatgcagacaggctgaaagaccggtagtgagactggagttcagccttcagaccggtagtgagacaatccttcagccgggagttgggctctgggtggcctaggttgccatggcaccgcctcgggctccaccctctcttgtccccctcaccgctccccccctgcagcgggggttgtggcagccagtcacgtgcccgccgcgtagccacacctctgctcctcagagcaatgtcaagcggtcacgtgtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaattaggaacttcatatccctttattctctttattttttatttatttatttatttatttatttatttatttatttatttattgagataag

SEQ ID NO: 8512 - DNA, 1705 bp, Homo sapiens
gctacggcatgtatggcttcatggatgtcgtctgcataggtgagggcacctctctctcctttacctgctctgtatcttcctcttacacacctaactcccctgcccatcccctcagtttcctggctttattttctgccactgtagcctttagtgctatcctggtgccccctcaacccacttccctgcttctccagggccctttgcaactgtatcttctcactctgaagaaatgcttgcttaagtacctctggcctagatctaggccacagttaaccctggatttcttattcctattgctcaggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgt

SEQ ID NO: 8513 - DNA, 1151 bp, Homo sapiens
ggaggacctggtgagtaggggacctagaggaggtggaggccctttccagagtggttctgtatttggacttaactcagtgccaggaggatgggataggtgtctaagggccaggggcagtctgaacagtgggcaaggacttattggacccttccttctcccagagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaagtgttgtctctggagagtccttgggaaggtgtgggggtggagaccctctcctttttcacattgaccttcaattccagaacttcagagctagctgactggcacagagcctgatagagttgcagtggggaatgagggagtaaggagcagagaggtaaactgtgggagattcttttattttaattttttttagagacaggccctctctctgttgcctaggctggagtgcagtggtacaatcataactcactgcagccttgacctcccgggctcatgtaatccacctcagcctctcaaggcactacaggcata

SEQ ID NO: 8514 - DNA, 1233 bp, Homo sapiens
ggctcactgcaacctccgcttcctgggttcaagtgattctcctgcctcagcctcctgattagttgggattacaggtgcacaccaccacgcccagctgatttttgtatttttagtagaaacagggtttcatccatgttggccaggctggtcttgaattcctgacctcaggtgatctacccgcttcagcctcccaaagtgctgggattacagacgtgagccactacacccggcctgtttttaagtaccagagtgcctggcacatagttggtgcttcataaaggtattcttcacttcccccactcccgctctcctgccccataccccttttcctctttctacaaaaactgaaaatggtatctcttcatcttactgcatatcctatgtaaatgcaaagggactgtcttccaaactgggcctcttctgtgcatattttggtaccatcacagacatcacaatttgttggtgtgttggttttttgtttttgctttaataggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactc

SEQ ID NO: 8515 - DNA, 3799 bp, Homo sapiens
ctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtagtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaatgtgagctgccaccaaccttcattggcccttaagtgttcactgggcccatggcaagcaccgcctttcttctcgcaaccccttccatcatgaagcagctgcacccccgggctgagtggggtgttgcacccaccgggaggccagctgcagatgccacacagggcttccgctcaaggttacacaagttctgctgtgatcaaccccattgcagtcaggtgcttagcacgtgtatatgcttgatgtcctattgacttctgggcatgaaccagaagccctaagggaatggattattatttttttttttttttttgaaatggagtcttgctctgttgcccaggctagaggcagtggcatgatctcagctcactgcaacctccacctcccaggttcaagcgattctcctgcctcagtctcctgagtagctgggattacaggcgcctgccagcacgcccggctcatttttgtattt

SEQ ID NO: 8516 - DNA, 1253 bp, Homo sapiens
acttccctgaagttctcctaaatacctccaactccgagaactagcccagtatttgctcacttccttttgcctttcaactccatttgatatatgtttcccacgacgtagtggagacttctggctggagaggctggaaaatataactctgaatttcctacaatctcagctccactttctcccgcgcgtaggcccccggctggagcggtgttattgtcacgtggccacggggacgcccgcagccgagtcggccaatgggcgcgcgtcggcctctacccgcccgccttgctactccgccgcgcggggacttggcgcagtgccgcggggtggaggcgaaaaagtttcttttgcagacaagaaggggcttcggcgagccgacgctgctcaagctgcaactctgttgcagttggcagttcttttcggtttccctcctgctgtttgggggcatgaaagggcttcgccgccgggagtaaaagaaggaattgaccgggcagcgcgagggaggagcgcgcacgcgaccgcgagggcgggcgtgcaccctcggctggaagtttgtgccgggccccgagcgcgcgccggctgggagcttcgggtagagacctaggccgctggaccgcgatgagcgcgccgagcctccgtgcgcgcgccgcggggttggggctgctgctgtgcgcggtgctggggcgcgctggccggtcagacagcggcggtcgcggggaactcgggcagccctctggggtagccgccgagcgcccatgccccactacctgccgctgcctcggggacctgctggactgcagtcgtaagcggctagcgcgtcttcccgagccactcccgtcctgggtcgctcggctgtaagtattcttcccgcggggggagggggcccgggccgctggagattcgagaaaacaggagccggcggggaatggggttcggcgtgcagtcccctttttgccgtatagctccttctggcccaggccgcgatcggcgctccgtgggcgtggaaaaagaactgtccgggcctcagtttccctcccacgtgctttgcgggcggcgcaggtgggctcttggcgcgtcctaactggctgcaggtagaccagggttgggggccagtaacgacgccagagattggggatgaagtcctgcgccctaagctagccaaggggttcaaatgcttgctcctgccaggcccaggggagataagcggcaacctgcacacatcaggagtttgcagttctcgctgagttatgagtctg

SEQ ID NO: 8517 - DNA, 1313 bp, Homo sapiens
gtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgatttt

SEQ ID NO: 8518 - DNA, 1234 bp, Homo sapiens
acagtactggattctctacattttaaccattggcataattatcattaatataagatatgtttggaaacagtaattgctcgtgtatgaaattacaaacttattaaacaatattaaggaattgttaacattgttagggtgataatgatattatagtttttttttatagttaacagttgttatatttaggtggtagatacatcaatatgttcaagttccttatactattcttggttttttgtatgttcttgacattttttataataaaaaagtaaaaaaaaaaaagttagctcaagattgtttccccactttctcctgaaataatgtagagacactgacagaagaagagatgttttcattgaatctattctactaggaaagagatttttgaagtaatgtttttaaagttttactctgaaaggtaaaacagccacatgttgcatatttatgtgtttaaaacaaaaccttggatgaactaatatttttctactttgctttttagtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtattgtaaaatagattggactatcagcttttaatgagtcatgcttatatattaatactttttcagttaaacttatttcttttaatttttaaagaatttccatgcatttgtgtatttgacaaaacaggaaataactgtgtcatattgtaaattgtacctcataaagagcaaattaaatattaacagccttatctctgtttctgtcttcatctcttattattatatctctcgtgatttctgcctttgcctttctgtctcctttttttcccccagttttcccaaatggtaaaaaccaggagttactaaacaacaaagggtaatcaatcccttaccatagagtagaaagcttttggggtttttgtttgttttacttttgaggtctacttatagatatgtaatttaaatataatcaaaagagaattttattaacagatgaatatc

SEQ ID NO: 8519 - DNA, 1222 bp, Homo sapiens
ttcaacctcgttgatttaattttctgttatcctttggcagaagttctgggaaatggtataaatatgtataagtacatacatattttggggtttttaattttttttatttcagtagcttttggggtacaagtggttattggttacatggatgaattgtatagtggtgaagtctgagattttagtgcactcgtcacctacctgagttttgtttttaagattgaaacattatttgatatatccatcatcctcctcttggtgccctttgttcctatatctgaaaaatttttttactgaatttctaggttgtgataattttaattcccattgttagtaccttagtacctagtcatatattttccagttctgtaggattttaagcagaaaaattaagcaaatatgctttcaagtgtctaatatgaagagaaaatttgatcgcttttatgataatagtttttttttctcttcctaatataggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggtaatataattttagtggctaagtaatactgcatatagttctctgaaattttttttattttgctatatatttgcggggataaattttagatcatcaagattgttttatatgtatactttgggata

SEQ ID NO: 8520 - DNA, 1311 bp, Homo sapiens
tctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaacttttttctgtcttttctatgaattcactgtgaagtttctttgtatcaggtaatggtctgtctggtttctttatatcaggtaatgataatgatacaaagagtatcatggctcaatgtgagattatcaactgtgaacacagactcgaaatccagagggaatggatgccaacactataagccttcacaggaataacagtaaaggctaatacatttcaactatgcctttggataccattattaccatggataccattagtaaacacatgaataattcagagaaaagaattactcccaagaggtattcttaagtgagagggctagagcctaatcttgctgaagacagtaagaatccagacttcc

SEQ ID NO: 8521 - DNA, 1102 bp, Homo sapiens
tactttgctctgccaagcttctggggccttgggcagatcctggcctaggtctctcgtaaatacttcctctgaccattgctgcgaacctctaagtgtggtggcggcagggggtaggctttgctctgcttttagagctgctggaaaagacagatcccattagaaagattccagagatggcagtgttttattttgtcccttagagcccctaactttttataattctaacttgatgatacatcacgataattttccctcctctgtttcccttaaaactatgagcaaataggggattttccactgggagcagagtggagttagcccattttctcctttcagcactttctacttttattgaggcaaagagaaatttccattctctgtgctctcgagcacagtagccactagccacatgtggccatttaaattagctaaattacataaaattaaaaatttatttcccgagttgccctagccacatctcagttgctcagtagccacatgtggctagtggctgctgaattggaccatgcagatatagaacgtctccatcatcacagaaagttctacggcatggtgctgtggtctacatagtagaagagcgtgggtatagttgggaatggtgtggtgcaaggagctctctgtaactcagcatcccaacagcaaagagttttttgttttggtttgttttttttgttttttttaaagacagggtctcactctgtcactcaggctggaaggcggtcacatgaccatggctcactgcagcctcaacctcccgggctcaagtgatctcccacctcagcctcttgagtagctggtactacaggtgtgtgacaccacaccctgctaatttttgtgtattttgtagagacagggttttgccatgttgcctagactggtctcaaactcctgggctcaagcagtcctcctgcctcagcctcccaaagcgctgggattacagggatgagccaccaaacctggccccaaagagttttttaaaaggtgggatgggtactgataactgtggacagggaatggtgtagccacaccggcctctggtgcctctgatgccagactctgagtcagcagaggggtgggcttc

SEQ ID NO: 8522 - DNA, 1450 bp, Homo sapiens
gaggagttcaggtgtaaattttgttactataaatcacttgctcatctaacaggaattgtttacatgtagctgatggtctaatttttaaatgttcagagtcctaaaattatgaacagattatatgtcaaaaattaatttgtaatatacaaggtatattatggttgaactagtttttgtggtcttaggctggaaattaaacacctagtatatagaagcaataatatttcaagtatacatattcatttatagcattatttctatgggaaaatgcacccagaattctaactaggatcttcaagaacaactctccccaggtcagtgcatggagcagaaagagaagggaaagggatagaatgtcttcatgactttaatcctagtatttgaaaaaaaaaaatcaaaccttgcacctacaaatttctgtcttgatccagaaagtcattagcataaaaaagataatagtggccttctcacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgttggcaaatgtaaaaaaaaaaaaaaagataatagtgagtattttattatttcaggaaggtaaaacagatcttttaaaatggctcgttgtatcattatgttctcatttagttattttcagtatttactttttctttgtaaaataaacgtgaaagtggcttgttaaattttttttagagaaatctgagtaatcttcccagaggctcctgaagaagatttaacttttttctcatctgattttcatataatgtattcaattctacaagttctattgctaaa

SEQ ID NO: 8523 - DNA, 1168 bp, Homo sapiens
cccgccagatctacgtggcttgctccttcatccccaactctgtgctcagatgctgccgcagtaagacagtccctcatcacttatttaagattgcaaccctacccccttagaaactcctgctctacttactcctttgctcttttctcacagtattctaccccatctaaataatttactgacttcacttggtcactatccatctccaccactagaactagaatatatgctccatgagggcaaggtagggaagagaggacctagcactcccaaagtatcggttgaattattattatccattcagaagtgttacggtgactcctagattttataaatgtacaactgtaaaatgttccaattcttcaacatttttaagaaatctgtttgggccaggattttggatatctcttatgcctatcatctctataaagtttcaccatttcctgaaactgattttattaaaagataaggtatttttgttcacaaactatatacttagtaaagtgaaaactacagttgtttttctgattttctagctggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctag

SEQ ID NO: 8524 - DNA, 1578 bp, Homo sapiens
tgatttttgtccctctgcgcttgcgcttgcgcttgcccccgctcaccttcccccagctccggcccctagccccagcattcgctctcctcctctcacggaaaggtcgcggcctgtggccctgcgagcagcagtgccgagatgaaccccagtgcccccagctacgtcctcgctgtacgtgggggacctccatcccgacgtgaccgaggcgatgctctacaagaagttcagcgcggccgggctcatcctctccatccgggtctgcagggacatgatcacccacggctccttgggctacgcgtatgtgaacttccagtagcccgcggacgcggagcatgctgtgaacactatgaattttgatgttataaagggcaagccagtacgcatcgtgtagtctcagcgtgatccatcacttcgcaaaagtggagtgggctacatattcattaaaaatctggacaaatccattgataataaagcactgtatgatacatttttctgcttttggtaacatcctttcatgtaaggtgggctgtgatgaaaatgattccaagggctatggatctgtacactttgagacacaggaagcagctgaaagagctatggaaaaaatgaatggaatgctcctaaatgatcgcaaagtatttgttggacgatttatgtctcataaagaacgagaagctgaacttggagctacgtgaaagagttcaccaatgtttacatcaagaatttcggagaagacatggatgatgagcgccttaagaatctctttggcaagtttgggcctgccttaaatgtgaaagtaatgactggtgaaagtggaaaatctaaaggatttggatttgtaagctttgaaaggcttgaagatgcacagaaagctgtggatgaaatgaaaggagctcaatggaaaacaaatttatgtaggtagagctcagaaaaaagtggaacggcagacagaacttaagcgcaaatttgaacaggtgaggcaagataggatcaccagataccaccgtgttaatctttatgtgaaaaatcttgatgatggcattaataattaacgtctccggaaagagttttctccatttggtacaatcaccagtgcaaaggttatgatggagggtggtcgctgcaaagggtttggttttgtatgtttctcctcaccagaagaagccactaaagcagttacagaaatgaatggtagaattgtggccacaaagccattgtatgttgctttagctcagcgcaaagaagagtgccaggctcacctcactaaccagtatatgcaaagaatggcaagtgtacgagctgtgcccaatcttgaaatcaacccctaccagccagcacctccttcaggttacttcatggcagctatcccacagactcagaacggtgctgcatactatcctcctagccaaattgctcaactaagaccaagtcctcgctggactgctgagggtgccagaccccatccattccaaaataggcccagtgctatccgcccggctgctcctagaccaccatttagtactatgagaccagcttcttcacaggttccatgagttatgtcaacacagcgtgttgcta

SEQ ID NO: 8525 - DNA, 1482 bp, Homo sapiens
tccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagttgttactggtttgatggttcctttgaagcttgtgtgaaatgtaatggtcatattcgtcttttttcccatgattgtgtggagccactgttttactgggtgtccacagcaggtatgccagcaacatcagcagagaccagagagcccctcagagtccatgtaggaagcctgcccacctagggtggactgcctggcagaagaaagaagaaccggccaggcacggtggcacacgcctgtaatcccagtactttgggaggctgagacgcgtggatcacttgaggtcaggagttcgagatcagcgtggccaacatggtgaaaccccatctctactaaaaatacaaaagttggccggttgtagtgacgggtgactgtaatcccagttactctggaggctgaggcaggagaattgcttgaacctgggaggtggaggatgcagtgagctgagactgtgcagctgcactccagcctgggtgaaagagcgagacctgtctcaaaaaaaaaaaaagaagaagaagaaccaagaatctactggcctattttttattttctgggaagaacatgtgtttttcctttttttttttttttttttttgagacagggtcttgtctgttttccaggctggagtacagtggcacaatcacaactc

SEQ ID NO: 8526 - DNA, 1157 bp, Homo sapiens
gacagggtttcaccacgttgaccaggctggtcacgaactcctgacctcaagtgatctgccggcctcggcctcccaaagtgctaggattacaggcatgaaccaccacatgcagcctagcctcataacaatcttatataaataagatctttacaaaagaaaacaagttagaaagctaactttaataattatcttacatgatcatttatagagtcttgtcagggctggaattagaaccgtgatctgttgacctctaatttagttttcttttcattctatggtcctgggagaaaatttgtctttataagtatttgacatatgagttggtgtgatagattacatttcctgttcctaatgcactttttctcattaaatgaagggaactcaaaaaataaaagctttaataagactgaatttcattctaggagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaaggtaagtgtgatcacagttaaaattataaagtgcatgtatctacacagacagaaccacttgtttggtgggcacacacatttgtgtttccacagttggataatccagagaattgtctaaatctttgtcctccaaatccagtcagttagatttggttgaagaaggggataggttacataccatttacatttttgccttgacaactgtaaatctttaactcctctgacttctctgatataaatgggttgtgtgtttaagaggatcagctgaagtgttaatataccaaatatatattgggacgggacatctttggttagtcttggttaccttaaagagaagagcgtgaggtttctcttcagttgtattgtgtcctgaagatcacccaagcagctgttttttccgcctctagccatactttttgttgacaaacaacagcatgaaagttgtaaagattgctaatttagaagttaaattgttctataatatatttaagaacaag

SEQ ID NO: 8527 - DNA, 1236 bp, Homo sapiens
tttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttca

SEQ ID NO: 8528 - DNA, 1112 bp, Homo sapiens
aaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgtattttgttctaagatgcatgttgacactaaagtgtgtgacttggtgattttgatccctttgtctgaagaaattgttttaatgattttcgtggtcatttaaggcatagctgtgtcaggcagtgaacatatctacccagtggtggcacaggttaagtgttagtgagtggaggaaaacagattggttgaaaatggactgggaaagattagtgttgtgccttttgatgctttccccagcccagctccctaatggtagagtgatttcactgacagaagttcagtgtaatgagttgaggtagcatttgatgtggcattttggttggtagggaggcagatgtgtattgggaggggaactcaca

SEQ ID NO: 8529 - DNA, 1204 bp, Homo sapiens
ttaccaaccaaagagatgcatgtgcaatagaagccttccttaaaaacaggctaaataacctcattttatgcagcagtttaatctgagaacagagggaaaggtgtgcagtggttccagaggggccttatattctatttttagtctagatattttttgtttataaattcccaaggaattgttaacactttggtgacacctaatggattctttttgaaattccaaggtgcttcagttctttgcccaagtgaactgtgccttttattgcatttctgttcgtctcttggtggctcttctgactttttggagaatacccatcttgttggaggcagacttaagttgttatgctgtgccacacaatttactgagacaatcatatcttcctaagcatttaaggaaagttgaaaaaaatagaattagctataaaatatgtatggcacatcttgtttaattttgcatgtaacttctcttttgtacattgatgaggttttagtgacattgtcatccaacactttacctttattgttcagggaatgccttcgtgattttttgtactggttttattattcagactatggcctggatttgagtatattgttattaccacctggttttttaattattcatcccagtaaacttatattttgtgaagcatttgtttctcagattaagacactgttagaacctaaagtagtagctgatgggtatctgtgaattttttttttttttttttttttacttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaa

SEQ ID NO: 8530 - DNA, 2205 bp, Homo sapiens
gagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtgggaatgtgtcctttgttttagttcacaagtagtaattttgacaagatgctttcttctgatgcagtttgttttaatcactcacctagtactggaaatgggctttctagtcagatcctatagtctctacctgtatagctcttacatacatggcccctactgataacccctgaatgaagcaccatgtagaaaatatttcctgataaatctgtatgtatttacagctttggagaaaaagtcttatcttggctggctttcaaacagactaggctcgccttcaaaggtgctttgccatgtgatccattgctctagatgaggaatgacttcttacggggtcaacaaacttcttatagggatagacggccagtattttaggctgccaggccatgtgttcactgtcacagctatttacctctgctgttataacacaaaagtagccatagaaaatggataagtgtgtggctgtgttccaatacaattttattttcaaaaacaagtaggtcataatttgccaaccccaga

SEQ ID NO: 8531 - DNA, 1988 bp, Homo sapiens
ttagcagtcttgctgtatgatttttttctttccttattaagtcaagagcgttcactttttcacttaaaggaagcactttatggcttctctttggcatttctgaattggcagcaccactactcttgtggtttggagccattgttaaataaaatcagggtgacttgaacacaagcactgtaataatgtaacagttgatccacccctactccctcaaaagaaaaaaatctcaaatcttgctgccttctgacacctttcaagactaacctacttgtttttctcctcttgacttgcactgtgtgactttgtgtgtgctgactggtgatagaaatgttcggaactgtcgagggctcatgttttgtaccatagactttctcactagagtcccttctggtgatttgtttcttttacaccccttcctgctatcctttccactgaataatattctgagtgagaagctagtgagagctaatgttacatttggtttttcctccccagatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggc

SEQ ID NO: 8532 - DNA, 1144 bp, Homo sapiens
agcaaagaggaactatgtcagggttaatgcatgtatagagaagtaccagtcacttttttgactttataaataaattggaaaaaaaagtttctgcgttgtatttgtaggtttgtgtagtaattgagaacaaagtttcaaaaatcagaactaaatttggatataccttttcaccggttttgggtactccatgtacagtatttgttagaaaggactatatgctcatcgtttggggattaatgttttgtgtgattttctttgtgactgtgggtactaactgtaatgtatgtaaactgccatagcaactaatggtacatataaagttatttaggaagttactctgagttcttgtctgttttaacagttttgaacagagttgaggagcatatttttaatatatttaaatttaattgcttcttagagtttagatttaattgtttcttatttaatcaataaactttaaaatagctctaagtaaccttgttatttaaaaatggcaatatataatctggtatttttaatatgaatactttacatttgtttcattttatctcatttataaattaactaaaatggactgattttaccaaggagtttttctatgttgtgtaagtgtggagtttacctaatttacttttattctaaggagatgcacaaatgaatatcttgttagatagctgacacgcatttaagctgtggtataattcctctgaaaaacacatcatgataatatctcctaggaagaaatctttaaatttcaccataaataagtaatttgaaatttaatactaaaaaggaaaatgaattgtctcccatattttactatatttcatgttttttggatgaatagatagaaacgctcccatcgcctccgcttcattttaaaaagcttaccactgactaacaaaatttgtattgagaaaagggaagctgaagctagtgcctagtttaccacctaaagcaaaatttttaaagttgatctattcctaagtaagggttgatttatttttagtgactctagtgacaggcatttgtaaatgacccccctacgccgctcatctttctgaaaattcttcatgtgtatgcatacattattccaatttccaaaacagaagtaggctttcttttttctaaagattccttctcc

SEQ ID NO: 8533 - DNA, 1183 bp, Homo sapiens
gagaatctccaaggttatgcaatactataaaatggtggtttgagtagaagttctgtagttcatccttatcagactaatggttttggggtttttgaaaaggaatgtttcaaggaggtctttgaaaaccattttcttcaaatgttcattgcatctgagatcccatttttgtccctttatttgctccagaataccgcccaactgccaacaaagaagggcttgtgctcccaggaattttctgcattcctctctggagtaggcatttttctcagctacaaaggccctttggcgaattccctctaatcattggatttgccctgggctctgataggtgccattcatggacttggtctgctgtttgatggggctgaggcattaatgggatcttttcatgataaacaaaactgggtaacattaccagagggatcacaaagctgctgttgtagggggagtgtggtgctttctctctctttctctttctctctctctgctttttccttcttcctcctcttctccctgttctttttatgaacgcacatttgtgtgcgtgtgcagcatggccatttctagaagcagatcttctgacctttgctgctactcgtaagtcaatggccaatggcaaggcctttgttgaacataagatgattctatatactgatctgatctacagtagcttcacagcctgcggggaggtctgtgttttcttaattgattaaacgttggaagaatactgcatgaagaatctgattttgagatctttcttacatgctggcatttaattactgaaagtatctggtagttgagatgaatgagtctgggggaataaatacttaacacaagaattcaacttcatgtggctgctgtggtggtatatccctggctgtgttatcaatgccagactgaatggggtaactcgtcactgttgttgtatcctatttgcttctcaaaagaatgcaaaaatggttagttgaaacctgattcctgcaatagtgaagaagtgaaattagaattattttaggtgatgaacactatttttttaaagtttttatttttgtgggtatgtaggtgtgcatatttgtggtgtatgtgagagattttgatgcgggcatacaatgcttaataatcacatcagggtaaatgaggtattcatcacctcaagcatttatcctttgtgttgcaaacaatt

SEQ ID NO: 8534 - DNA, 1183 bp, Homo sapiens
ttttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatt

SEQ ID NO: 8535 - DNA, 1266 bp, Homo sapiens
atttaaaaattatatagatctctaattacggtgcagccagttagaaaattagtgatgttctatggtattttctgtaaattttgttgaagttcatgtcttctgggatttaaaaaattattaataaagaacatattcataaacacttatgatgtttataaaccaacctgaactttatttcttaaagataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtaaaacctttgacatttcatctgtagataaaacatttgtcggccgggcacagtggctcacgcctgtaatcccagaacttttgggagactgaggcgggcagatcacaaggtcaggagatggagaccatcctggctaacatggtggaaccctgtctctactaaaatacaaaaaattagcc

SEQ ID NO: 8536 - DNA, 1414 bp, Homo sapiens
tttatagttgttcttagacatgtgataatcataatattattattattgcctgtgcatgcacttacttggttgcagttcctggtgatatcattggataaatgtaacttcttgaagtttcaggaaataaacctgaaactgagtagaacctgaaataaacctgaggagggaatatgtactgttgtctaaactgttctgttgatactttcccataagctcaagaagcacaagtatcaaaacttgccaaatgaggatccaatcaagtggagaaggaaaaggggtgctcggaagcagcccccagccccctctctatcctggaggcacagagtgtgggggtcttgcaaattactttcttgctggacacttgtggagtgagtacaccctgagggtctgggagaggcctaacctccacccctgagtcccatggtccctggtgcctgcccagggccaggctatgggctcagatgtcacactttccttgcctccttccttgtcacctccagagatttggattcaggatttgttcctagtgtccaaaactttgacaggaaagttaacttcttttttttttcagacgaagtctcactctgtcacccaggctggagtgtagtggggcaatcttggctcacggcaacctctgtcccctgggttcaagcgattctcctgcctcagcttccccagtagctgggattgcaggcgcctgccaccgcacccagctaatttttgtatttttagcagagacgggatttcactgtcttggccaggctggtcttgaactcctgacctcgtgttccacccacctcagcctcccaaagtgctgggattacagacgtgagccaccgctccagagactgatgcccacctacaaatcttgatagaacaattaaagttttttgatcacaagcttcaaaactgcaaagataataagcagagaaagaaaactgaaactctcaaagagaagcaaatagcatggtggaatcaatgaaacactgcactgtgttgatgcagactgctgaagaccagaataatgctgagaagcacgcagatagaattataagtactattaatcttgtagatgcagtgtatcaacctagtccctgggaacctgtgatcagcacaatgccttcccagactgtctcacctccctctggaacctactcaactgcataagacagagcagagttcatcttcctgaccagttggacctgtactaattgccttgggacatcattagactccaacaccaaatagtagaggcagtgcccattcaccacctagtagcggtctaacttctccaagccatgtcaatggcttctctaaatacaatcccagaattctcttattccagcagtgaagatgaattctacaatgctgatgaatgtcatcaacatggctcatccccaaagcacttaataga

SEQ ID NO: 8537 - DNA, 1200 bp, Homo sapiens
gagaaaggtaatatacatttttttttcaaatttgaattaagtacttttcctgcataacagttcagtactgtggtccgtcaccttctccccagcacactgggcatgggaaataccatgtatgagttttttttttttttttttttgtagatgaccctcttggtatcttatttttggactagtatccatttaggctttgggcttgtacttaagagcaagtatattttaggttaacaatttatatcttctgtgggtaacttacctttaagaaaaggatgtatatttcacatatatttttgaaatttgagcttttttggacagataattataattcttgtaaactcaggagattgctatggatctttagtaacagaaattgtaaatataaacttaagcaataaatgatgcatttttcaaccattgttcctgctcctagaatttttaagtaagctacatacacacaattcaaatattaagacatttgcaattatagctatttatgaaacaatttgcaggattctaaaaccactactagccattagtgatagatactattttatagtagaaattcagagtggtggagctgtttatgacgctaggaaatgtttgtgctttttaaattttacggtaaaataaaaaccattagtatggcataaatttattggaaagtagattaaaatagaactactaataggtgtaataatttcatagttcagtcattttacagctatcaagtggctattatatatgagtcagtctgctgtatgctggttttgcgaagcattggagacagagttttctgaatattcacttaaatagaagataagacaaggaagaattataaaaataaagacaaatatgtaattttctagttatcgctatgatgcatacaattttccttaagatatatgctatagtaaagcagtgattaagcttgagtcttatagtcagagaggcttaagtatgtattctggggctgggtgcggtggctcactcttgtaatcccagcactttgggaggccgaggtgggtggattacgaggtcaggagatcgagaccatgctggctaacacggggaaaccccgtctctactaaaaaatacaaaaaattagctgggcgtggtggcgggcacctgaggtcccagctactggggaggctgaggcaggagaatggcatgaacccaggaggcagagcttgaagtaag

SEQ ID NO: 8538 - DNA, 1154 bp, Homo sapiens
ctaagaaaatgaatacctctgtattttgactcttgtttccttctttaaagtacagttcagaggggtgattttaatttttaagccctaatcaatctgagctgttgttactgtagaaaccacatttctcatcctgaaacatgacagcagtgatcgcccctgacagttcatagacctgaatttcagacaatcaaaggcaaagcaatttggaggtctgatcatttagaattttcacagtttcaaggaagcacagtacaggttctcttccaatttgtcagaagcaaggaaaagcgcatagttggagagctgagtgccagctttcagccctaggtatcagtgccaaacacatttttattattctctggaaaataaggttgtaaaaaagtaattgctgacacaaccttaatgatagcactttaaggatgctgctgtaattaaaataggaattttattaaactagacctctgagagcctaacatacgtagcattccgatctcaggatttacaaagcaagcaactttgattcctgctgcttttgctgtgtgggccccacatttcctttttgcctctcctagttgcagcgtacgtagaaaaccacctctctcctgaaaaaagcaataagcatccatgtttagaataatgccctgtggtgatagtgccacagctttagcacacttacctctgaaatgtcatgaaaggagctcctctctcctttgatttcccttgaaataaaactgtcatgtgttatgcagtgaggttaaaatcctacaggatgttttggttaaaatttgaagaaggctgtcttacttcagtgggatgtcatatccattttattcctattttactgatggatgggttagatattgtacacagctgctagatataaagacctaaaaatagtggctttaaaaatttagttgattatttttcatctgtgatgagaattttacaggttggtggcccacgtgtagtgatgctacagtcaccagtgggacccaggagccttccatttttcctgcttggacatccttaacatgtggttgttacctcaggccccaagatggctgcctgagctgtagccatctcatccaagttccatggaggaagaagggcaaaggaaagagttacatcccagctacatcagccctctgctttaa

SEQ ID NO: 8539 - DNA, 1199 bp, Homo sapiens
ttttcacccatccccccaactccctttttttagcagatcttaccacccacaatcctagtgaggttcttgggctccatctgctccttcctttgtgcactcagttctcttaaacacatcggtcctttgctccttcccttctttgcatggctggtcattctacatctggctgtcatgggctgacctctgctgaacctcaagctatctggtcttgtacaaattacctactctctgtgcctcatcatcagctaccctcatttccttctcgcccctgcacaatattaatcacttgcatttctcccagtaggccttagcatgaacactgcctactgtgtgtagacacctcaacctctgcttaattgggttcactctttcttacactgcagttgactctggcatctggaccttagacatgccggccataggctcccataccctccttgcatacctttattatagtgctagttatactgtatttcaattgcccataagctctgccttatctactcttatactgttgtacctacagcagtgactggcacatacggtttaagaaatttaaaaaatatgcactgcaagttgagccgtgaaaaaataaggagtgaatgaatgaatcttataactagttgccattcaattcattctgccttgacagtgcctcttaactctgttactatctttgtcttccctcctttgctgttcagcttcctccagctgaagcttttgtttatttttggagaggcgattctgagtgctgtttggagagtggcttcacatatggtctttggagtcttgctgccttggtttgtagcctatgtggcttggtttgctcagtatgtggccttgtccaaattacgtagtctctgtgccttatttatttatttatttaacctataaatgaatgatagaaataatacccccttccacagggttgttgtgtggattcatcgagggagttcctgtgtagcactaagcacctggtatgtagtaaattataattatatgtaaactatttaaactgttgcctccacttttttttttcctttttgcaagctacttcagacttgcaaataaaaatagagattaacacagcaaacacctatgagtgcagccccagtttaagaacaaaaataacaagatagtaaaagccacctgaggacactttcctatattacctttttcactttccttccctcctttca

SEQ ID NO: 8540 - DNA, 1135 bp, Homo sapiens
atttttagtagagacgggatttcaccctgttagccaggatggtctcgtctcctgacctcgtgatccgcctgcctcggtctcccgaagtgctgggattacagatagtttgtccttttttctttcttttttttttttttgcgacggagtttagctcttgttgcccaggctggagcgtaatggcgctatctcggctcaccgcgacctctgcctcccgggttcaagcctcccaagtagctgggattacaggcatgtgccaacacgcccggctaattttgtatttttagtagagacagggttcctccatgttggtcagaatggtctcgaattcttgacttcaggtcatccactcacctcagcctcctaaagtgctgggattacaggcctgagccaccgcgccctgccaagtagtttgtcctttaagcagacctccctcctagactgttgtatgttacagttagatacatttgattgcttagtgagaagaacagatatgtgtatgtaaaacggggaataaattgccttcctcaggttgttgtgagtattacatgagcctcacggctagaaagcgactagtaatgtgcttggtacacagaatactcaacacttgtttgcttccttcttccctcttttctctcttttccattggtagatgagtgccttaatgttagtagctttatattaattacctatgtatttttcaaatctgagccagagctggaacctagtcagtgttaaatacattaaatacattactacttaattaaatgtctcttgaataactggataaatgaacaaaccatactatttatcagaatttgaaacaagaaccaaaatttctaaaacatagaaccaaactcaagcagataccatttaaaaatgtaagttctagaacatcagagaagtagcagaaagctatgcgtatagtgagtgcctagtaacaacctttgcctgatcatcagaacaaatcccacctccctagatctctaactttttggaatttgagacagtattttcttcatccttcttatgtaccatcccttttaatgaattatatctaatatgttgctagtcaggaatatccgccttctaggaatcttagaactagcattaacactttcatttattttaattctgt

SEQ ID NO: 8541 - DNA, 1189 bp, Homo sapiens
gacatacctcattgtaaaaatactcaagaggaggattttgtaattttgtattaaattcttagagaaatgtcactcttacgctgcagatttggtcagaagtttcgttttttaaaactgttcagtaaatgtagaactcaccaggtccggttttggagaatagctgaaacttaagcatgacccttttctctattagtctttctgtccagtggttgccaaatgcatcttctgaggtcttcagctcgatgctgtgtggggaactcatgccccagttcctgagaaatgacaagtcagtgctggttctcccttcttccttttaagtgagcagcctctggcagatctttctggaagtgtagaaggttttcctcaggtttggactgagatgtggggatggtaagaacttctttcagtaggtagattttcatgtgaataagtgaaagggtgagggggatccacataattcctaaatattcaggaaagtggaaacaatggggtatggtttttggtaaaattccaatctcacatcactctgtcttccaggatgggtcaatctctatcttcctggcaccagttgctccattttctctacatgccatttttacccctgtggtttgggagaggggattcaatgggtttggcctgggtttctctattcccttgtgtagcaaaggagcaattgatgaagtgaagataattgtgatgtagaagaggtgattctctggcactgctctttagactccaaggcccttaggcaatggagacagtcagagtgtctcagttctgctgtgttggctcaggtgttggctacctctagaacctctttgtgcagtcaggtactttgtctttttttttttttaattgtgaaagagtttcaaattgttagttcgcatttttaatagctttattgaaatataatctacgtaacacacaattcagtcatttaaagtgtgcaagccagtgacttcattatattcacagaattgtgcaatcattatcacatcaattttagaacattttcatcattctaaaaagaaaaccttgtatccattaagtagtcactccttattttcccctccccactctaaaagtctctacccctagacaactactgatctactttctgtctcggtagatatgcctattctgagcatgtcatataaatggattcatacaatatgtggtcttttttaac

SEQ ID NO: 8542 - DNA, 1141 bp, Homo sapiens
tcttcagtgtggactccaaatgcagcttatactatcttaaagagggtagctattggtttcccacactcatgtatctgtccttttactatatttaaaaatgcacagactttattgagtagctctaattgagtcctatgatttgtcttggatgaggattaacaggttgtagtctatttgaataatatgttcaggaggaatgaaggactttcacagtgttgagcagtctatggtcagtctttgaatccacaaacagaaaccattttggggccaattataattcagcatggactgcaggtgttaatacttctttaaagtctgcatcatgctaaatcactctgagaatgatagtgggtaaaaatgtgctctttgtagataaaattttattcctaaatgataaaagatagtactgcttcctagctgttttgctttttaacagcaccaaataactcaatacagccttcagatgagttgaatgcgtggcctcctgtcaaagttaatcgaaagataagcatcttcctccatgttgttagcaaagcaggtgaaaccagtggctaattaccctcaaaaagaaagctaaataatcccctcttaaaatcttcagcaattacatatacaatatcaaatacattactttttttgcttgattcccaggggaaacaatctttagctaattcagttgggggacacaagaggatgcggttttctaaaataaaaatcatgattaaaatagccagctggtcttgatcctgcacttaaaatatttcagaccaaagtcattgctatcctattttgatataaaactccagtgtctcaattgcttaggcccttgaaacaaatacaagattaattcttgaaacacattttacctcacatttgcaggttttcttatagtgtacttttgtgtcaaggtgaaatgactttttttttcctggagaaaggaagggatcagatactttaatttttatgactataatatgcacatattgttagtgaaagcatatggatttttaaaaaaattattactaaggacaatctacatttgtagattcttctagaatcttttgctgttattagttacaaaattaatagcatctatagtttctttagcacttactgtttgaacactgtgctagcacttcct

SEQ ID NO: 8543 - DNA, 1174 bp, Homo sapiens
tggctgggtgcggtggctcacgcctgtaatcccagcactttgggaggcagaggcaggcagatcacttgaggtcaggagttcgaagccagcctggccaacatgatgaaaccctgtctctaataaaaatacaagaaaaaaaagccaggcatagtggtgggcacctgtaatcccagctacttgggaggctgaggtaggagaatctcttgaacttgggaggcagaggttgcagtgagccgagatctcattgcactccagcctgggtgacagagtgagactcagtctaaaaaaaaaaaaagacatccttattctgtattattatttatgattatactcatttagaagcagttaaggtaagtaggaaagaactgtgatctattctcagaatggttaccctcataaaagtaaaagttatcgtgaaatgcaaactcggctactaagtttttttgtcgatgagttcaagctaattttaagactctggatatatcacctacccaacccaagcctctggttgcaatggtgaaacaatggtgatgaacctgatgtcatcccactgtaaatattaaacaattttgatgtaaattttagatgaagagaagtcatatttacatcaaccttccagtgcatgttgcaactgatttatttattcagcgatacttttttagaatgtattctgtgggggaactgggtgctgctctagtgctgagggtgtagcatttttcctcactttttagtgcttactctttgggaaggaggtacagcactaagaagttaaaaatgcacgtaaatagatagtttgtcaggatgagataaatgatgtgtagaatataaagactaggttagggaataataatggaggagaggctattttagatatggtagttagagaagttagtttccaatttccaagtggaatctaatttattctctctctcttttgtttttatgtatttttgatgtcttcttggcagcctcatatcattgctaacctctccactccatggaatcacattttcctgcaaacgcatcatgagcacttatttaaatacctaatcattggcagaaatgcagctgtgttcatcattgtcaattctgatttgtatgatgttcccatccaaacatacctcagggtacatttgcacatctaattacaacattaaaactaataatagcctga

SEQ ID NO: 8544 - DNA, 1123 bp, Homo sapiens
atttttgttcctttagttgagaaacacaaagtattcttttatttgctggccctgtgggcatttatatgttctgtcctctcattacatcggtagaagaccaagcctaggtgaatatgcactggcatttccacaaataatcctagttactgaagagcacattcatctgggtttggttttctaataacatgttgattatataccgatttctgtctatactgccatacattaaccataacatagttaaaatcgggattaggggagttcatcttaaaattgattaaataagtacaatttgaaaggtaaaccttttaaaatagtaagtccatgggagagaaagagcaagaatcattggtgctagatagtctgggaactactgtcctatgttattgctggtaataaagcaaaatgtggcaggtaatgaatcaaggagtaaaatgcagctcttcaaggcagcttttgtttttgtctttagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaaggtattgcaaattaaatagaatcttttgagtttttgtgaaagacacttatagatggagatgattcttagtccaaattgtactgtttgttttatttagttataatagtgaaaagggaaatgatctcaatatttgacaacagcaaattaagttagagggcatccatgtattgaactgttatgcaacacattaaaaaatcatgtctaaaaatcattcattaatgctgttaataaggtgagtgaaaagtatgtagcaaaaattgctcaccatagcccaattttatttctttaagtatacagaaaaaaatctgtatatttacaactagtactattaccacttgttttctcttggctaggaactatgtatgatttttggttttaagtactattcaaattttctacaaagcatttttgtaaggagataaaccaaggttttagaaagaattgaatctgtagatatacatatttagggcagcttggcttgaaagaatattagtttgtttattcat

SEQ ID NO: 8545 - DNA, 2435 bp, Homo sapiens
gttaaagctcttcacaaacagatgaaagaaaaaagtgtgaagacccgacagtgttgttttaacatgttaactgagctggtaaatgtattacctggggccctaactcaacacattcctgtacttgtaccaggtatgaaagaaacataaatctcttttgggacttattgtagcctttttgttaggacttagataagcttaaataattgtttccttttaaaggaatatatgtgacaacttaatatgcacatagagctaactttttaatctaacaatcttgaatacctgaagttagaaatttgtaagtaaaaggttaaaagtctcaccctaaaatatttggctgtaatatttattgtagatggtgaaaatttctacttatagaaataatataatgaagtgggaacattagcagtactataggggttgatttttaatttttctttcttaaaagtctgcacagcaatgattggattttttgttggctttttaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggtaggtatctagattttcttacttaaaaagttttttattgatagttggttgccttaaaagacacctaataaagaagttaagccatgtctatattttcttaaacctaaaagctaagtatgtgatgaagaaaaactgtctttcgtagtatggagtgatattcaaatgacattttgttgttttaaaggatagtgtggtaattagataatggttaaatctgttctaattcctcatgataactacattttaatgttactatattgtgttaaaatgtggaaaagatgtatctaatgaattaacataatctgaagagcttgttgatactaattacaataagtataattggtgacagtacttttttcaaatggaagattctggaagagttttcagatttaccagtgtcatccccattagaacaagtaaaaggtagtaatattaatagcagtaatagccattc

SEQ ID NO: 8546 - DNA, 1169 bp, Homo sapiens
tcagaaatgatagttgcgttgctgctgaaagaaacgttatggttcacttagtgtttcatcaggttcttccctgaccgtcactgaagaaataacaatgacaccagcaaaaataaattatatcaacttagagaaaatataatgtatattgtattttaagtttatcatgtctgtctgttgcttttcttgtaatatttcaggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtaagttagatcacactgtttatttgagcttgtctttgacttaagtattgtatatccacacgttcttttttgctttaacaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaaggtaagatgtttgtgcctatttatacaatgttttagaagaagactttgctagagcaactttcacccttgtaatttactcatgtgtctgagaaaaatcaggttgtctgtgaagattttgataagcatattgtaaactataaagtgcaaaagtaataggcagtgtaacaccagttgacgtgtaagaaagatccagagccctttttattggaggaggaagtggcagtggatgcaaaatgctgtgtgcccacttgcttagtgaatagtccctagatcctttccctcaaaaaagtcccgacagattttgctgtttaaagtataaatctgtaactttttggcctgtcttaacattggaccatagttgctacccatggagggttttcttagcattgtcttgattaagtctcctgagctacctttggggctagtctgaattgtaactgtatcatttacctgaatgaggaatttttgtttttcaatataatatactgtgtttaatatcaagaattttgttataggacatggaacttttcagatatacaaaacaatctgtagaagct

SEQ ID NO: 8547 - DNA, 2639 bp, Homo sapiens
ataatggggctttgtgtaaaatattcccttaaaagaaaaggagacagctactttaaaaataagtttaaaaacagttgttcttagaatgtaatatgccttatggacctacgagagtagcttttagcaggaagatcttatgtgcttaaattttgttcatgtaagagctgtcttttatagcatgtaatctaagtttactccatcttacaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgt

SEQ ID NO: 8548 - DNA, 1807 bp, Homo sapiens
tcctaagattttcatttaactgactttcaagagggcagcagaatagacttcatctttttggaatgaaaaggtctgccgtgaattgtggtatgttgccactaatgtaatgcctagaacaagagcctagattatattcatttctaacacttttaagactgttttcttaactgtttgcttttgggtctttactttttctagcccatgtttttaattaatttttttccttttgacaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggttttaattgtaataggtgcattttacacagcatggtttcataatttaacatctgggcaagccagactcattaattacaggaataaggaagtagcgagttttctggtattgtttgaatatccacataaccaccttttgaacttttccttgagaaataattttgtaaatcaagcagtattacttacgaataaatgcctttgggtaatgttcagtagctatttgatgaggtaggtaaaagaggaacgatttaacatactttca

SEQ ID NO: 8549 - DNA, 1246 bp, Homo sapiens
cttgattatactactttaggagtggctttggagagatatcatcccctgtaatccgggaggcagaggtgacacggactgcacggaaacagagtgctcagaaaagagttttacgtatcctttgcgatttaagcatcattataaaaattgtaacatgtttggaatcagtgttgtagaattttctttttataagagtattaaatggtagctataataaaatcctgtagaaactttttttcactccacagagctgtcatttggtaaatataatgcaaaaatttaatgagatcgtatttccctaaaaataaagatatttcttactgctgacagcttctgctgagattagatttctttttattatttgaaaactgactaaaaacatttagttcagtgtgtagttatctaagactgacatctgatcatttaaatggcagaagcaatgaattatttaccctttgcattgaaaaatggtagccctaaaatacttgttcttgaaaaatgtattcacataatttgtatagtaaaaagatggttaattctcattttagtgatctcttttctacatggaaaacttttcttaactcgttgtacagttcaggcatctcaagatgaaaattttggtaatactacaccaagaaaccaggttatccctcgaactcctagctcatttcgacagccttgtaagattttttgcttttaaagcatttaataataacggtaattataatagcaactaacatttattgtaacataattagtatagtatttggttacgatatcaataagcactaataataatgattgcagttattattcgtttgaactcttgccatgtacaaggtactgtactttccataaacacacggtaactatgacatgggtattgttggccctgttttaccaaaactgaaagtgagacttagagaagttaactaatatatacaataagtatgtaaataggctggatgcagtggcccatgcctataatctcaacactttgggaggccaaggtgggtggatcacttaaggccaggagttcaagactagcttggccaacatggcaaaaccctatctctactaaaaatacaaaaattagctggcgtggtggcacatgcctgtaatcccagctactccggagggtgaggcaggagaattgcttgaacccggaaggcagaggttgcagtgagctgagattgtgccactgtactccagctggggcgacagagcaaaaaaaaaaaaaatcccagtt

SEQ ID NO: 8550 - DNA, 1175 bp, Homo sapiens
aacttctattgtatcatgtgtaaaatgggtataataatagtgcttatatggttgttataagagttagttgatacataaagtatatggtagatattaaatacatgttagttttttcttatctgcattttaattcaaaaacaagatgaaattcaaaatactttcctttaatgggaggaagtgaaattggttttattcacaatttaaaatcatagcagtttaaagctgtaagggaccagaaactcttgagagtcaaatcttattgtaaccccaagggtatataccttctagtttctgaaatacttatcagggaatgaagttaggttcccagatggtttttgtgctgtttaaaaattggagtctgactggccataactagacttagatttgcactcagcatttattttctcttttatgtctcaaatttccccttaaaaactagactgggataataaaaatcttggttttattttaatggttaatgagggggaaaatatcttgcagtggacaacagatgaagacttaactgaagcagttcattctttgggagtaaatgatattttggagataaaattttttgaaaatcgggcaaatggccagtcaaaggggtaagttttttttttctttctttttgatttagtagctagtgatacagtttttacaagttaactttcctttaagttaatgttaattacacatgtatacacatgtatacaaacaacacatgattgtttacattggaaggaggttcttgggcaaagattgatacttttcattttacgtaccctattacctaacacactaaaaccagtagagtggaaatgtggacagatttattttctatttttcccaagttttctctatctgtggttgaaatggttgttgaaatgacagtttaagaaccattactctccctgtgattaagagatgggagaagatgggcaactgaataatgtgttacatggatattttgctttatttcactactaaactatacaagtgggatagcctcagcatgagaacattataaatacagatatctaaaagtaagaaaataaaataccactgtcctaccattcattgatgtttacttttaacattttagtgaagattcttttgggctttttcctaaaaataaataaataaataaataatggaattataattcatgtgtttta

SEQ ID NO: 8551 - DNA, 1156 bp, Homo sapiens
aaggagagctatgtggatgtgtattatggtgggggagagatcactgataaccagaaaatgttcattgatttttctgcttggcaacaagacctttcaccacttggtaaactgaatatagaaaagatttgtcattatacatttaagtacattatctttaaagagatgagatggatgattatgtaattaacagaaattcaagtggttccttttcttttaatgttttagcacttaagacttaactgaagaagtgtgttacaaaatttaaatgatgtaatactgaaattaagatatctgttgaagaatttcggtcttggctgctgcagagtgctggtattttgaaagtaactcacgattacctatggaaaatatatttaaacctggatattttgagtctttaaaagtacccaaatagatgtgaatgttttcctaaaccatactttcttatgtagtttgcataggcacaaggcatttgcaagttaatatattagaaatagagttgtttttaataatagtggttacatttcagaaaactatttttaataagtgctatttatgagtatttggatatttgcagctacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggtaaaacttttcttaaattaccatggataaaacatgtctacctaatacctcttttccttttctctctttttcaagtaatgcattattaatgtgacttactctccttgttatgctatttttggaatccaggaaatttgatcaagcatcttgttaaaggaactcggcctttgttcctggaaactaggattccatggcatatggggcacagcatagaggaaatacccatttttggcctaaaaggtctttatttttctccaaacttgcttgacttatatatagaatatttacatccgtcttactttcttacctcttaaaaaaatcctttcaagatcatttttccttgtttcactttctagcttggcatcagagtagaatataaggtgggtgatttcactgtaagaagtgtgt

SEQ ID NO: 8552 - DNA, 1182 bp, Homo sapiens
tgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaaggtaagttagtgtgtatctgtgaaagtacttgatgataaaagataggaacaatgactgtaaatattagattgtaggtatataaatatgttatttctgccttccaagaagatgaggtgtttaagctgctaccctgttttagctgaaagatactggtataggagaatttttagatttgttctctttgttggaaaagtagcatgcttcaatatggaaaagtaactactatctctaaagcacatgtcagaagcagctagtatgaattgctatacactgttgtgactaactgaggaaatctgttgagtatgagttaaggtttatgtttttgttttacagggaaatggatactgcaagaacgccattgagtgaagctgaatttgaagaaatcatgaatagaaatagggcaatctcaagcagtgctatttcgagagctgtgtctgatgccagtgctggtttgtgtatttcttgtattaatatttcttatttatgttattaggaatgacctaaaaatgtaagtacaatctagaagataggtcatttacatgtagtagttctttttatattcccaaatcattacctacgatttatttaaaaagcattgaaaaaagttgtgtgtcacagtgtagtggggaaaatccaaattttaagttatttggtatagatttaagtcttacccttgacatttaatggttcaggggcctcatgacaccttatttattcttatatttgcaaaatgataatgtgcttcacacacgtataataagttgagtcaatatcatgagcatgaaaggcttttgcaaatggtgaaacactgaaagaagacattgtcttgcatagttattttatagcacagtacttttgtaaaatgccttatcactcttatcccaagtggtttgatggtgttttgaaaacaaaatttgtttgacttcaaaccctttcctttccctcacaggtgattatgggagtgctattgagaca

SEQ ID NO: 8553 - DNA, 2264 bp, Homo sapiens
actggtcataattgttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgtgcattcagtaaatactacacatctgttttaggctactagtttaatagatgatgtgatgcatttctgtgatgtgtctggttgctgatttttttgttaatgtttttaatagtgaaatttctggttcatgcttacctggtgagttggtaagtcgttattggcagctcaggatagtaagtttaaaccagatttacaaagaatttttgctgcctaagtttttttagacatcaaaaaattgaatatttttaggctatctaattatggagagcattaatccagtaatttcttttagaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaaggtgggtattccttgttccctgttaaatgtgtgtgtattcttaacagtaactataactccaaggctactgtttatacagtatatacctacattttaaatggtccaactacttgtgaatttaatcttctggaaacatctgaaacaaattataggtaagtaatgacaggtaaaaattttgaccctttatcttatgaatattttattgctgagttatcactttcaggtttcaaatagttaatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaatttttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcatgaagtgggaagagttgtctgtttatgcttcattttcacatgtaattttattttttatatttgttaatagcatttattcatgtgaagagctgggggagggcactataaggcttatgcatgtgacacaaaggttattctgtaaattaaaatattttttctttatatgttggttggcatattcaaattaaattaaggctaaacaaacccctcataggtaaatactctttatgtgattattttcagtaatcatgggaaacttactgaaaattcagtcatggtaattgttagtatttaaattgttatgggcaaaattaaaggttttatcaagtgtatgtaattctgtgacagaataccaatttctttaaccataacagatacgcaaatgaagtccttaaatgcctagaaaataagcatgctatttttatggaacacagatataagctcctacactatttacaattttaagggctttttgagttaaaaggctggttttgatactttgcattttgaatatgcagattgaatatcaaaactttaatttgtagttttccatgtattacaaaatttaatataaatctcaaaacattcttttaatatgaggcaaaaaaaccttttacttttaaaactaagcttattgaaattgatattgtttttgaatgtaaaaattgaatgttgtattatgtaaatctaaacactaaattttaaagatgtagcacttttttcccctgagtta

SEQ ID NO: 8554 - DNA, 1114 bp, Homo sapiens
gctgttaaataaattaatttgtaaaataattttgcattttatatttagttcagcatttaattgttaaatgagtttatagacttgatatgtgggtgaatgaaaaatatttacataaaaatcatccaagcattttccatttatttttgtagtatgcatattttagaaaatgacttatgaatgtttccatcatcacagaaacagtagctgctatgttttcattactgcttcagtcattaaatttataaggcaataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatatta

SEQ ID NO: 8555 - DNA, 1090 bp, Homo sapiens
tttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaag

SEQ ID NO: 8556 - DNA, 1524 bp, Homo sapiens
ttaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaacattttgttttgaaagtgtgttctttttgtcgcactgttactgcgtaacacttctcaacattctgtaagttaaattattttaaaataactatggtgaattcatgtttatttttttactttgaaaattgtagtactcaggtggtatttaatgggaaaggatcctttgggtataaatcataatgtattttaaggaatgcatctataacattgataactttagccttaaaaaaaaggtctattattccttcctctgcatcccatggtatattagcaaagtagtttacagccctgtacagccttacaaagttgttttacaatttttaatggaaagcccttaacaacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagacttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaa

SEQ ID NO: 8557 - DNA, 1128 bp, Homo sapiens
ttagatcctctcttgggaattcagacattcttcccctcccccaacctgcacccatgtttaatgttgtaattcttaagttatccacatttcatcatggaaacattgtcgtcaggaaatgccatatttattaccctgtcatatatcttaaacatgtgagaaaaatactttagtaaaagtatttgttttctttagttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaactccctcaatacagttaaagtatctttatagtattgtgacatcacatctcttattggcactcattgtcgcatgtagaagctctttgatggtaaagattatatcttaagttttgttctgcctatatcatagtgtcattattcttcacatacaaatatattaattcttaggggccaggcatggcggcttacgcctgtaataccagcactttgggagtccaaggcaggtggatcacctgaagt

SEQ ID NO: 8558 - DNA, 2833 bp, Homo sapiens
cagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaa

SEQ ID NO: 8559 - DNA, 1248 bp, Homo sapiens
caccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgat

SEQ ID NO: 8560 - DNA, 1096 bp, Homo sapiens
aagtactgttatcatttgcacgtacatcttctaatattctgtttatgtagaagtatgtgtacttcattatgtattttatactcatgtaacatactgttttataaaacagatactatttatcaatacttttttgtagcttgctcttttaaattcctttcagtgtaagtagataacactgcccctttaactgtcaaatattatcctgtaccttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctcttatggtaaccaatgatggtgccactattctaaaaaacattggtgttgacaatccagcagctaaagttttagttggtaagtctgaatatactttttcaccaacctaataatactgtttgttaacatttttgaaataactttataaataggctgtgttgaccaatcgtactgtcaattgatgtccactagttgttaattatcgttgttaaaatacaagcttcaggagtgcccgtatgttggtggtaaaactgttgcatttcagacctcagagttccaaataatttgttgaatgaggaaccctggtaagtttagattggtagtgaatatttttggagaatttagtaagcaaagaagcaattttgagttaataactaatttctttttctagatatgtcaagggttcaagatgatgaagttggtgatggcactacctctgttaccgttttagcagcagaattattaagggtaagagcaactaagcaactcttttttcctactgtgtttttgagtatcagaggtaatctagtccttacttcctctgtctttactattgaggagtgct

SEQ ID NO: 8561 - DNA, 1666 bp, Homo sapiens
gggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattcttaagcatggaataaattgctttattaacaggtctgtgtttgcttttaagaaaggatttttttccatgaaagtttatggaatacttcatatttacttatattgaattagattttttacctaggaactgtcttagataacttcacttaaattatggatttttgtaatcagtaaattgtgatttatgcacacttacagtgaccagaattacgggattgatttatacagttactataataaagaacacttcttttcaatactagtaatggatgcattagtactatagttgataaactctaattatataggtaagaaatgcaatcttgttctaatttgcatttcttttacttgtggtaaaaatgtttacatgttttttagtctaatgtagtttatcttgtaacagttgtgagcataatgttttcatgtattttatttacaggcaattaatttataattatcctgaacagctctttggtgctgctggtgtcatggctattgagcatgcagattttgcaggtgtggaacgcctagctcttgtcacaggtatggaaaaaaggtattgttttctaacaaacacaatagtcactcttgaatttgttatttgttactatatgcaactacctttaaggagtttagaatttcagcagttattctgaaatctattctcttggatacctttaatttagatacatagatacattacatttacgataccaagttatataccacatttgccgtaggtatagatttctttcattgtgtcactgttttaaaggtagatttttggccaggtgcagtggcttgtgcctgtaatcccagcactttgggaggccgaggcagccagatcgcttgagctcaggagtttcagaccaactttggcaacattgcgaacccacatccctacaaaaaaaaaaaattggccaggtgtggtggcaagcgcctgtgatcctagccacttggggggaggctgagggaagagaatcgcttgagcctgggaggcagaggttgcagtcagcggagatcgtgccactgcgctccagccttggcgacaca

SEQ ID NO: 8562 - DNA, 1500 bp, Homo sapiens
aattttaagcctgctgtgcatttaactaatacatgtttatgtttataggtggtgaaattgcctctacctttgatcacccagaactggtgaagcttggaagttgcaaacttatcgaggaagtcatgattggagaagacaaactcattcacttttctggggttgcccttggtgagtgattatgtagatcctggttagggtgtctaaattcttgctaggctctgttgaagtaaaggttattgtagttactagaatagcatatcttacaagtcttaactcttcagaagcatgatacatactttgtttcagtctcttgagtcaacctcatatttaccgtgtctttgtgaacagtgcatgttcaacagttttttttccttgataacttagaaccattatgagccttgattgttggagaatgtataatacaggaagacaggtcagctttcagaacccagtaatataaccaacaccggcataaataatagaaggcaaactttttatccctaagtggtcactgtgtcttttaattttaggtgaggcttgtaccattgttttgcgtggtgccactcaacaaattttagatgaagcagaaagatcattgcatgatgctctttgtgttcttgcgcaaactgtaaaggactctagaacagtttatggaggaggtaagcatttagaaaatgttgaatatatttttaatttcttaaagtacaatataagtcataagtggttttaatggttcttacagaaatcttatattgcttttgcactaaattttaaaatgcttggcatatcttaaagtcagtaattcagtatcttggagacaactaagcattgcaatattttattggaattttaatctttaggctgttctgagatgttgatggctcatgctgtgacacagcttgccaatagaacaccaggcaaagaagctgttgcaatggagtcttatgctaaagcactgagaatggtaagttaatcaaaatgagagatccgaacttaagttttgtggttattgatagttttaaaatgagtagaaaatgaactggttaatactgcttttaaatttgattctggagtttctcctcttcgtgagcagtaactgaagcagattttacattgttcctaaatgtataattttaaaaagctatcctagttaggagtaaatcagtggttcttacagtagagtgagtagttacttgttttcttcattttcatagttgccaaccatcatagctgacaatgcaggctatgacagtgcagacctggtggcacagctcagggctgctcacagtgaaggcaataccactgctggattgggtaagcaatcaaggggaactttgtggccgttgttaaaagtaactcttttcactaagctttttttttcttttggaacataaagagttacaataaccgtataaaagactcttttggactttgtcctcataatcattacatgtgctgggaaaatgtgtgtgactttatatgctcagcatttcccaaact

SEQ ID NO: 8563 - DNA, 1192 bp, Homo sapiens
tcactatgttgttcaggctggcctcaagcaatcctcctgcctcagcctcccaaagtgctaggattataggtgtgagccactgatcctggccccttttattttatttatttattttttgagatagagtttcactgttgttactcaggctggagtgcagaggcatgatctcagctcactgccacctctgcctcctgggttcaagtgattatcctgcctcagcctcctgagtagctgggattacaggtgcccaccaccatgcccggctaattttttatatttttagtagacggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcatttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttt

SEQ ID NO: 8564 - DNA, 1238 bp, Homo sapiens
aagattcgtaagttagagaatagctcgaataattgagtattgagtatattcacttaatgaaggtaacagcattgacatttactcaggatgctgaatgtctaccttttcttgggctaaaatgatagtctctgatgtatttaacaaataattgtgacaaaactggtgacttttgctttattgataaaactgggatggtcacaagtctgtggaaaagtttatgtgaattattgaaaaaatgtaggtacatctttaggaaatgcacaattgacatttcagctaaggttttcagcgaaacattaaaaataatgaagatggtattttatgatttaaatatctctcttttctgtttgtatagttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgat

SEQ ID NO: 8565 - DNA, 1244 bp, Homo sapiens
gtgttaagaatatatgttgcattctcattttgttgcatgggaataaacctacacagaatgaatcggtagctgtgtgaataacttgtatttctatctatcatatataatcatttggaggggaaggatttatagttaaatgattgaatgtgaattgtatatttttgagataactggagaagattcatgtaaaagaaaaaaatatgtcagttgtgggaggggtaaacttttttgtccacttcattttttattcactgtaaatttctcccttgtgtgtgatgtctggcagacagtcttaattgaagaaagtagaagtgggtaggaagaatgtttcatatttaataatttctgttgcaaataaagtatgccagtctagcccgcgaaaatggttacgaggaagactagagtatagaacaattactttttgttttttgttttctgtgtatcatattgaatatttttgctgctgttgatatatttacatgttagtaattttgatggcttttggataattccactctagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtaagaccagtctttcttcttttttctctattggtcttatagctacattgaaactgttcaaatgtgttatatgtaattggaaccagcaaattggttacacctcaatttgaaaatttgggtttataattttaaattaagtactggatttgatagttgaaatagttgggaacacttttcaaaataaagcatattcataatgtatattttttagtgtcaaatcaggttttctgagatatttgtcaaaacttagattatttgatatacaagttatgacttcatgactgaattcaaaatggtaaaaacaaaagtgttgattgcttttacgtatattattcctggaagactaaacccgaagtcttgtgctatattttggataacaaagtatatatcacagaaatgtagacaaaattgagtagagtatagaagaaatagaaatgagaaacccagggtgcttagagacccaaattctattgaatttgttattagtttgctgtccttaaatgctagattcttgttttctcatttaataaggtggttaataatattcattccttattcagtgtgtaggaaggctggaagaa

SEQ ID NO: 8566 - DNA, 1212 bp, Homo sapiens
catatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttatttaaatcctatattcagattgttttgttttaaaatcttaaaatttttctctttattatcttgtttggttaaagtgccaggttttttttgatggaggggtccttatttgtttttatcagcatggagcagttaagaaattcactttttcccaaggattgtacttatatcagagttatgtgtaggttttaaaagttcactggtccacctttacgaattttaagtacatccatatagtacaactttaattctgcttgttgatggtgttaatgtgtatgagagccttagatttaatgttgagtactcaagagagcaagagagtgtacaaggagtggataggcacaaagtatttgaacacactgtcttacatgttttcataatggccaggtaagctctgtctttgcattttctggaaaagtgtgcaagtttgtggtgagcactgcttttttttttttttttttttttttttaaacttagtactttgaattagtctgaaagatgaatctgggtttggccagtaatgaagaggtgaacagggagtcataatgttgaaactggacattcagatctttatagcatgatttccttatttttcaaagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtaagtatgtggtggggaaagccgggggaaaaatggtactgtcatcagtattttgagggtggatgttgggcca

SEQ ID NO: 8567 - DNA, 1240 bp, Homo sapiens
acaaatgaataagcaggttatatcattgaaataataactttataccagtatgatcaatgaaagattgtacttcagttacatgagtgggtacttgcttgagataaaattctagtatgccactatatatgcactgattcaaaaaacggtatatttcagtaaacttagattgtaaggaaagatgaatgcttgggaaaacagataactgagaaaataaggtgatgacagatacacaaatgtggaagatgcatgtgaagattttgaataattaaacctaaacttaatttttaaaaaatctatgtatgggaaaatgatattggccatttttgaagagtaaggtatacttagttttttaaaaggaaatggaattgttaagataggctttatgtgattctcctacttttagggtctggaaataaacatctaacactttattgttataatcagatttatgactttatcacatgcgccactagccattagttgatcaatttctgtatcttagcaatgctcccttcatgttctgttttccacataggagtaaggtaacactgaacattttccaaagtattacccctgataaaagtaatatttttgtttaggtgacaaacagcatgtttggtgcttcaagaaagaagtttgtagagggggtcgacagtgactaccatgacgaaaacatgtactacagccagtcttctatgtttccacatcggtcagaaaaagatgtaagttaatcaattatgttgtattttttcagcaatgtaagtctgtgtctgggttcctgaaaaacagcatatcaagtgcagaatactgtctgtggttgagtgacaatcttttcagcacagtgctagtccctttggtgcttgtatccttttgggatacaaagacaatgaatttgtattctaatggggaaaataaatatcccatgattctcaaattgggatatggtaatactgtgatagaagtactcaaagacatggagtaaacatggtataacttctagatcactgattttttttgtttgttcaatatgggaaataacttgtttgatattaaaacaaatgcagatatagaacagaaagcagatttacgcagacttgaagatataatggcaagctgtaataaaactttatgcttattgtgtcatctagctgtaattctggacctcaggtgtatctctcctctgttcagccatagggatactataataggaaaaatttggaagaactgtattcaaaatgtg

SEQ ID NO: 8568 - DNA, 1595 bp, Homo sapiens
cggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcactgcagtgttggctttgatttgaaattgcgaaattatttcttcaacatgaaaaatagaggaaacaaactgaagttttacagatatcaaactgaatggtgtgactcaaatgtctttttcagcttccaacaagtaatttaatggaaatatagtgaaccgtttcacttgtaggttaaaaatgtagacagtattaatcagagaaaacttttttaaatgggttgtggcagcattagaaataaaacattctgaatactcttggaacccaaccaaagtacttctgtgaaaaatttatgagaaatttcttgatagacctttaaatttatctttaagaagtaatgtgcaaatgaaggtaagccataaggtgggaatgggtagactttaccttcagtttgctggcctagatatctcatatttacaagttagtggattcttttcccatctaaatacaaatactgtattttaaaa

SEQ ID NO: 8569 - DNA, 1159 bp, Homo sapiens
aattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaaaaaaaaaaaattaatgactttttaattcatgagaagatggatactgttgtgaggacagtgaacagagaggtttgcactaccattaaattccttgttctcaaattctcagtgtttagaaagtgcctcccaaccgtagtttgaatgatttgcctagtgacatgccatcttatgttgaatatcagtgtgattgaatgcaaaggagaccttgctttttattttgttttcagtttatatttggttgttttaa

SEQ ID NO: 8570 - DNA, 3512 bp, Homo sapiens
tgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaaggcacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaa

SEQ ID NO: 8571 - DNA, 1198 bp, Homo sapiens
ttgaggaaattgaggctgaagtttattgaaacaccaccaagattacatagctataaaacatgtaaatttggatttgactgcaaaccccatacttttctagtaactttttcttccttttaaacataatagtaagctgcatttaccctttctatattttgattattttccatagaggaatttttaagtaatattttgaatatctacccactgtagtagttttattggaaagcagtgaatagaaaaatagttaattgctatgtgcctgaagtgttatgtgtaagacaaatatataataattgacacagtttttcccttcctttcttgattttcttatcttctcatgctgttatgataagcctatgttagcctagaaatttcacaactgtttcatgcactattaagggaatcagttgttggtgctttgatgctgagcttacgtgttttttctgcatatgaatgtctggctgcctgtatctattgattttcccaagcaactttcctctctctttttacttaaatctcagttaattcttaacagtgtctcatttgtagaattatatcaatgtagttgcctgttgtgataacttctctatcaaatgtaaaagggagataaaacacatctctatgtccgtcacaattttcctgttttcttggatacatacctaacgttggatgccaaaatgctgctacattattgtatttccttactttataaattaaaatataacacatatacagcaaaatgcacatgaaaataaatgtaaagcttattgtaggatctaaaactaaatacctgtataaccacgatgagaatgctactagcatcccagacatcacctgttggccctggccaataatacctctcacacaagatgacataaatcttgacttttaatgttgagtccatttttgccttcggttgagaatcatgaatggtgctaccttatgtgttctttaactcagaattgtctttgtaagccccatccatgtgtggcatgatactgtattttattcattttcattgttgcatatcattttttgaataatataaaagcatttaaccattctatttatgatggacatttggagtctttccagttgtgcattctatataacgctgcttggaacaatcttaaataaatctcttcatgcaaatagttctgttggaaacagacctaggaatggaagtactgattca

SEQ ID NO: 8572 - DNA, 2448 bp, Homo sapiens
agtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcttggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatggaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgttttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtagtattttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatg

SEQ ID NO: 8573 - DNA, 1222 bp, Homo sapiens
tggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaa

SEQ ID NO: 8574 - DNA, 2491 bp, Homo sapiens
tctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttct

SEQ ID NO: 8575 - DNA, 1151 bp, Homo sapiens
aaagttattaaggaaatttaaaaatgacaaatcatttgttaacatggtgtgagaaaaatcatggaaagtaaaaagtaaagttgagcatttcttcccttcatcatataatttaaactgaagagtctgtcttttttttttttttttttcggttgcccaggctagagtacactggtgtgatcacagctcatttcagcctcaagctgctgggctccagcaatcttcccacctcagcctctcaagtagctgagactacaggcgtgtgccaccctgcccagttaattgtttattttttgtacaaacgcagggggcgtctcactatgttgcttaggttgctcttgaacttctgggctcaagtgatcctcctactttggcctcctgaagtgttgggactacagttgtgagccatcacacccagcctctaagagtcttacatgtgccaaattaagtaacacagttattcctaaattttctgcttttgttttcctttaaaaataggatgatgatgctgaagctatccttgctgcagacttcgaaattggtcactttttacgtgagcgtataatcccaagatcagtgttatattttactggagaagctattgaagatgatgatgatgatgtaagcgaatttgaatcctgcaaagaaataattggttgagggtatagtggtcagaattggtaatagattagtttagtttttaagaagcaggacataatataattcaaaattaggctaattactgatgttctgtatatagcttttctgggttttaagtatgtctccttaggatttttggattcatttatcttagcttttaattttctgctaataagattgttctgagtttatgaaacttttttatgtttggttagtgctatagatctattatgcccttgccttgacttcacagagctaggactttctttagtgcacaagaaaacatttactgggaggcatagaatttctattcaaggtagtattgaatgatggttaggttaagattaggttgcatatagatgttttgaatatgtttattgctcaacggcaattgttagagtaggctttaggtccttttcgtacagtgcattccacacttaagtgtaggtgagtaatatttacagtaatacttgtctgatcatccactttatcca

SEQ ID NO: 8576 - DNA, 1131 bp, Homo sapiens
attctgatcccttttcttttgatggaccagaaattatgggttgtacagggtgagtttaattttactaccttaacaaaatgttttttctgtttttgttatacttgatttgtatactcggttattttcagttacatatgtacatagtctgtctctgaacattttggtaatatgttttctgaaaagtgcttatcaagtttcctgtaattctccttggacccatgactgtctcacatatatttttgcagaggaatgcttctttaaattatactatgtgtttgtgctaattgtaaatgtgtttattttaaatatttgcttagaaataaaatttttccctttatactgctatagaaaacatttgaagcaattcacccttctaaaatttgaaatctaaatagaacatttacttctaaaagtttagcagttgaaagattgtcaattgtaatagatttttcttctttgttttgcaaggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggtaaataatgttttagcttgagtattaacggttgttttataaaaagcattgcttagcttcttattcattgtaatttcttttctcaattttgcagttcctgagagtggagatctggtaagttgaattgttatatatttattgaattgttaagtatatttgaaattaaagcactgaatttcaaaaatggagagtgggatggttgttacattgagttctgaggcctacaatgcatggggcagactttttggatatgaaaaataattccattcaaaattatatcagtgcttctgctgagaaacactgagataaaaagcttaaggttttcttttcttttgaaacttcacatattgctgtgagggatttaacttttcaaaactgttgtcttccttagtaaaaccagaatatattaagtcacttatactgttacattcctaactacattatggttcaaattcattcctgaatttgttactccaatgtaaatatggtttcatattgtgactaagtatgttcacat

SEQ ID NO: 8577 - DNA, 1152 bp, Homo sapiens
ggagactaaaaaaataatggtgtgtggaatcttgtcctttttcctgatatgtctatgctcccctcctttttcctaataacttgtatgggtgagatatatgtaaaagaaaaatccaagtaatcattgttctcagaattaagatggtctgtccatgacttcagcaatgacaagtccaacacttaacttgggtaaagatttagggttgacaatatgatttacattttgtttatcaatttacccagttacatttctacttttgaaatatagccagtggatcaatgtatttatatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggtaatgctttctcctactttgtttaatttaacattctagaagacgaattctagaaacataagcagacttggaagaggttaatctttagaactctcattgaaattgttattagaggcagcacttggaggaactatcaataatagcagttaaagttgtggtatgcatttgttaaatttgtaagacttcttagtgagaaaccactggttttagcttggatgccagtgtttttatacagccttttttttttaaatcattttagcgatttgaaattattaatgcaatttatgaacctacggaagaagaatgtgaatggaaaccagatgaagaagatgagatttcggttagtaccaactttattttggtatgtttttaagatgataaaatcttaggacttgtcagaaatgttagcatttaatgatggagtacaatattatataaccagttgtattttttcattttttaattttacgtctttattacacgtttttctattactttatttttaaaaaacagtcattcaagattgtaatttgcatggcaataagcagcggtttcatgggttctaagttt

SEQ ID NO: 8578 - DNA, 1167 bp, Homo sapiens
gtacttgttgacatcacattccccaaaaacctgcaaaaccaattttataaagcttcaaaagtataaactttacatttgaccagatgcttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacccttgctcattgtcccatttatctactggtccatacttctagtgtgtgtgtgtgtgtgtgtgtgtgtgtgtgtgtgtgtgtgtgtaaggggcgggtaggtatagatacagcaactcaattagaagtcattgtttgcatcctgcactgttggagtgacttggtgtacttgtgtcaaacagctgcccatgagttttgtctgaatttagaaatgttacaggttgtgatgtggtgcttataacagtatgtttagtgtttaatatatggagaacatgtagtgtgtgtctttttaaagatccactccttcaagcagaagagccatttattaaatgtaggtaatattcacaatttattttagcagatatttttaaaaggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcctggctgtgtgtacatcatctagtaattgaattattatcagaagtaaattgacctcaaaaaaagtaattgggaaaattaagtttatggcactttgtgtaataactgta

SEQ ID NO: 8579 - DNA, 1208 bp, Homo sapiens
aggcggggaaggaaaacggttaccgggggccggcgagttgcaggaattaggccttgacagggagcgtccgccgtctaggctgcggcgagcgagggaccaggcgactggcgccagccctgagcgttcccagcacaacgccgaagggggcggggcgggccgggcgccgggcacgcgggccaggccttccccacaactgatggggttgaaatttcctttccggctcagcagggagaaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccggtaacggatgggggcctggaagggaagggggaacgtggtgttggctgggcggcctgcgcagatgggagggccggagggatggagggactgggagccgggagtcggggccgctggccgcccgtggcctccggggtcgtcctgtgaggtcggacaggaccgcggagtccggaccccggagcctgagaggggccccggggccgaccagcgcttttatcggggacggctgaggcgacgtaggggttggcgcggcctggaggcctaaggttctctgagctccaccgtcttttccgcgtggaccggagcgaggccgcggtgacgcccgggtgccctgagactcggctgcgccgcgaggaccgggaggcccccggcgtacgggccgggccgagtgcagagccggccgcctcttggacacccccctgcttttccctcaaaaataataccaggagggaggccgctgggagatgaaaagaacggcggaggctgcgaattccgacgggagggaggggctgtggagggacgagtccccgaggcggggagggggcgggggaggctgcgacgctcccgggctctccgcccattggggg

SEQ ID NO: 8580 - DNA, 1142 bp, Homo sapiens
atgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatga

SEQ ID NO: 8581 - DNA, 2356 bp, Homo sapiens
gttatttcattggaatgcatcagttgaaatattgaaatacatccataacattgggtaaatatttactccctgagcccttaagtattcctctttgcagtcccagaccccgcccccccccacccctacataccaccccatgacccagcaactaaaaattattaacattaaatgctctgtgactgtttaatatcaaattgtgggctctatgccaacatttctggcaaatcattacaaaatttgttgttgcttatttttatagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggt

SEQ ID NO: 8582 - DNA, 1189 bp, Homo sapiens
agtgaatacagggccgggcatggcggctcacgcctgtaatcccagcactttggaaggccgaggtgggcggatcacctgaggtcaggagttcgagaccagcctggccaacatggcgaaaccctgtctccaccaaaaaaatacaaaaattagctaggcatggtgacatgcgcctgtaatcccagctactcagggaggctgaggctgaggcaggagaatcacttgaacccgggaggcggaggttgcagtgagccgagatcgcgccattgcactccagcctgggcaacaagagcgaaactccgtctcggaggggagggggcatttgggggaatgaatacaataaagttgtaggatgaaaaatcaacatacaaaaatcagttgtctggctgccccacactctactgacgcggccgctgtctcggctgctgtgtgccgcctaggtgtctgggtgatccatgggcagcagcaagggccacgatgacagaccatgacgaggagcaatgcaagagctagaggcccaggagtccatctaccctaactccttcatagtattatcataaaatccacccggcttcaccattactgtgacatctgaggctggagaaaatgatgaaactgtccagactaccctcacgtttacatacagtgaaaaatacccaggtgaagttctcctttatgaaatattccctccagaaaatctagaagataatgatgtctcagacattttaaaattactagcattacaggctgaagaaaatcttggtatggtgatgatctttactctagtgacagctgtgcaagaaaaattaaatgaaatagtagatcagataaaaactagaagagaagaaaagaaacaacaagaaaaagaagcagaagaggctgaaaagcaattattccatggcactccaattacaatagagaatttcttaaatcggaaggccaagtttgatgaagaattcttggaaattaaaaagaaaaggatgaaagaagaagaacagcaggaaaaaataaattaagttggaaacaactatttgaaacagatcataatcttgacacatctgatatccagttcttggagcatgctggaaacaacgtggaggtagatgagtctttgttccaataaatggatgacttggagctggaggatgatgaggatgatccagactacaatcctcctgacccagacagtgac

SEQ ID NO: 8583 - DNA, 1252 bp, Homo sapiens
cttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaagagatggtggttgtattttttggtaggctttttttgcatactgttttgagtaaaaccattaacagctacaacatagccaaccaggccctcataaacacaagtcagatctttttgctgagatcaccccgtggttgctaaatgctgaatcttagtgcatcagaattacatgggagcttgcgggggttcaggtactgtgtaactgagcttctgatttctactaagtcccaatctctgtaggtttggagcttccagatgattctgatgtttatccagtctaggaatcacaggtaaatgcagaccacccctcaacttcttgtagcatccattaagtcaaatgcttctcattttagctaatgcccacctttcattgagagccaatttctattgttagccttact

SEQ ID NO: 8584 - DNA, 1122 bp, Homo sapiens
gaaaatcatatactttgatgcttttgtttcattccttgtgtagcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaagtaagaatcttcacctccatcaacttactagcacataaagggtgggatttcatgtgttgatattttctgcttccaagattaaaaatatatatattgtttttgacatacatactcctttcctgcattcatcaaggtttttggtgctgtgagaggtaagttagtcacctactagaattcagcttagagtcctgtcagtgccttttcctcggtggtttcagtagagtgaaaaacagaacactatcctgagaactccggtcagggagggtgtgaattattttgcatttctctttagtattgctgcatccaagacagaatgtctgagttttctttccccttttttccccaccccctgcatactcttctgaagggtggagatgaaaattgtctacaggtaagaaccagaagaatggccagggtaagggtggtgggacatggacagggagagagtttccaagtatcacacccagtgcatcctccttttctgtccatcttggatactgagccaaatgccctgggctgctggtagcctgtaagccctgggaaaccatgagctgcaacatctggctattttttgtttccagctgaaattacagtcaccctatgggtgaaatagctagataaaatcaggattgggaagaagaaagctgcatccagggtgaatgcttcctatttctggatgataattcaaactcctttgcttgatcttaacactgaggtcaagtgggtttcctacctgtaaatcaatttcttgaatagaaaatactttgtggtcattatcgtgcctgtctcatgtgctaccaccccttctgagtatttcctgtactttgtatatatttaagtgtttctcccaaagccacttaagattcaggcaaggcccatccaaccccttctcactgggtggctagaatgctacaatttca

SEQ ID NO: 8585 - DNA, 1157 bp, Homo sapiens
gttccatatgaatttaagaatttttttttctaattctgtgaaaaatgatattggtattttcataaggattgcattgaatctatagattgctttgggtattatggtcgttttaatgatattgatccttctgatccataagcatgtgcctctgatgtttttcatttgttcgtgtcatctacaatttctttcatcagtattttgtacgtttccttgtagagctctttcgccttcttggttaaataatcttgatttggttctcaagttgatcattcctggtgtgtaggaatggtactgatttttgtaggttaattttgtgtcctgaaatgatatgaattcacttaccaaggtctcagctccagtggtttctcttaaggattttcttgaccacttaacccaaagtcctcccttctgcagtcttcaattggtgatttcaagtaactatcacatggagtagttttagtgtctatttatcactatataaaatgatcttgcttatgtatttcttttactcattgactataactgtcttcttgaatgaaagtctatgagaacagggccttgcctgttgccctagtacttttaacactccctggtatgggttgggtgaatacatgcgtaaagtaaccttataagacagcttccttagtattattacatgggccagtatttctcaggatcatttcagttccttaaacaaacaaaaattctcgttagacaaatattcagatgcccatgtgtggtgatacacttgataaaatttgcacatcctatgttgacttttcatcaagtcaatagaatagatggctaattctatcatcgtaactattagtggctttcattgggattgagagaaactggccaagtgattttgtataacctattaatttggaaagtactgtgacaaaacaatggaattttaatttttttaagaaaagaacataagagtaatataaacacaaaataaattttgacaaaatttgtttctcggggaaatgttagttgacttttctttgatttttttcttgagtgggattgtgtcctaaactctgaaaggagggcagtatttgggggaaaacattttgactttttctgtacccttcactgaactccctctacatgagggagaatgacataatttaatggtgagatagggtcag

SEQ ID NO: 8586 - DNA, 1321 bp, Homo sapiens
ttggaaggctgaggcaggagaattgctggaacgtgggaggtggaggttgcagtgagctgagatcatgccattgcactccagcccgggcaacaacagcgagactctgtctcaaaaaaacaaacaaacaaataaaaaaacaaacacaaaaacagaatttcttacagttggaatattaatttatttttttaactcaaagtagaaatgtgatttcaaatactttgttgttgtaggcagataaagctatgaccataaatacgtagaaaactatatttttaattgaattgaagttctatattattttattactttactggtgatggagaacataaatgtgaattcatgatacaacattttaaattcagaaaagaactctttgtcaaatactaaatccaattctttgcttataagccaggtttcactccctcacaaattaatttaaatcctcccaggaatgcacagtgtccctgccaaaggttttcacatggtgattgatgaaaagatttgctgaagaatatgcattctttttaaatacattttaggagcagtttaatatagaggttggaaaatgaaataaattcatgatgctccatattttgatcatgttttgtgattgaactttttccaaagaacttttgaaaaagacacattcccttcagaattacaaatctgaagcttcttcacaataaagctttaaaagtgacttgtattgaaagcttttctttaatctgctcacatccgcacatctcaggttgtggtctgtattgcagggtatatttagccaatgagtatctttgtattacttagtaaattaaatattttaattccactaatgctgttgaaaggtttttagggtcagttgtaaacttaattgctttcagcttttctttccttttttattaatgtggtaacatatacgtatataatataaaacttagcatcgaaccattttaagtgtagagttcagtggcattaagtatatttacattgttttgtaaccatcaccattatccatctccagaagtttttcatctttccaaactgaaactacgtatctagtaaacaataactcctaatttcccacccccctctggccaaccaccattctactttgtctatattaatttgactactctaggtactttgtagaagggagatcatacatatttgtcctcttgtgaatggcttatttcctctagcataatgtcttcaaaggtgcatctatgttacagcatgtatcagaatttcctttttaaggctgaatagtattccattatgtgtatctaacacttcattcattggtagcttggtagatactggcttg

SEQ ID NO: 8587 - DNA, 1182 bp, Homo sapiens
ccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggtgagccgggcgggggccgcagccggaccgggccggggcgggcagctgcctcccggtgtcttcctcctgggagctacccggggcgcagagtttacctcccctggctcgtacttgtcccttcaccgagttaggcaggcagggggtgatggagttttactctgaacaaatgcttcctgggaagttccccaaactcagagtaggacacgtgcttttcaggcttcctggccaggtctcagatccaggatccttttttaccgtggtagaaagacaacttatggctccaggacttgcccacctggacttggctgacttggccacctggacttggctgtttatgcttgatcagttagaaaaattgattaatggtgacgacattctctagggtctcacgtgcccatgtgaagttaccagtttatttctcctttcttaccaatgtttaataacatctgtaaagaaaatgttgccttagcaatatccaagacagctttatcttacagtgagctcaagatgagtatatccaaatgaatacgtgcactattttatata

SEQ ID NO: 8588 - DNA, 2573 bp, Homo sapiens
accagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctgagaactagtttttttatgataataagtgggtaaaaattaataacagtgagtttcagggtagttgctttgtagcacaagatttcgcttccataaacattgttttttttttttttcttaaagtaaacctgtgctttttcttatctgcaaacataggcttagcgatacatataaaggtaatattccattgaaacatacagtttactttaatattagatcattttccaatttagatttgtccaaggttcgacctgctaacacatctataaataagaggcacttttagccaggcatggttgggaggcccaggcgggaggatcacctgaggtcaggggtttgagaccagcctggccaacagggcgaaaccccgtttctactaaaaataaaaaatgagccaggtatgatggtgcaatcgcctgtagtcccagctactcaggaggctgagacaggagaatcacttgaaccagggaggcagaggttgtagtgagccaagattgtgccactgcacttcagcctgggcaacagagtgagactccgtctcaaaaaaa

SEQ ID NO: 8589 - DNA, 1170 bp, Homo sapiens
tactagaaaacatgatttgggaaaataatgtataatatagtaagtgtaacaaatatatagaaaatctgaaactttctacatggaagtgggagaaatggtctaaaaatatttagagatttcagtttcatttctttaaattatttgcaaactgtaatacatatttactgtcattttaattcattattataaattatgtgatacagaccttaaatacaaaggtttttatttgctttcttaatttattaaaataattgctttactagaatgtatctaatattgttctttctttaaatattgactagaatgcttttctggttggaatttctcttaccaaattaatacaatggttagcagacaagtttttagattaatataactgtcattataaagatttaaatgaataacaaagctatttctgctattaatggacacaagaattttttttaccctaattccatctgaatttatttttatttttgataaagacaaaatgacacactagtagagacctagattgtattcccactttctcttaatgacctgtatgaccttgggcaaataccatgcacgcagactgagtttcttcatctgtacagtgagaatcattctgatacttgtcccagctacattattcgttgttgtgaagatgaagaggttgtacctaaaaaaaaatttggttagaataagtgagtaaagaaaaatgaagaaactatgaagttagacttataatgtctctagtgtgtttgtgactcttaatagacgtattggactgatttttttttaagcagttacttttaagatagttctcttgataaagttttcatgttctcatacctcagcattgtgtcctcatttgttgcctggttgctttgagtgacactgcttatatactataaatgtgtttatactctatcaatgaagcataatagccttatagtagttaagaaccaaataatgtttataacttcatgactgttagctttataactgtgctgcagattgtttaaagagcatgtttaagttgatgagttaagttgatgagtgtgctttttttgaaattagaaattcttatagcccacattttactctaatttgattgtgtatcagctgctgtttgcaaagtagattcatttatcaagggagaaagtgaaaataaaggttagtagagtg

SEQ ID NO: 8590 - DNA, 1847 bp, Homo sapiens
tttccaagcatcatattcagggcaatattctaagaaagaagcagaaattggaaggcctttgaggcctagtcttggaagttgctgagtgtcacttctactgctttctattggtcaaagcaagtcacaaagccagcccagattctttgcttacaaacttgaagcaagtacaatattttatgtatgtgcaaagaaagatagattactaataattattattttcttctttaacaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttg

SEQ ID NO: 8591 - DNA, 1099 bp, Homo sapiens
aggaggatgttagctaagaaaattgtatttgaagctcataagtgctttaaaattcttatacttacgggaatattaagctctgaaatgctaaagacagttacatgttttatactctgtagaaagggtttctatcataaaaataaaaaagaataattctgtatttaaattttttcatcattaaatatgatcacatttcaacttataattttacaggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtaagtaatctttttaagtgataaattactgtagtaaattgcaattgggtttctcaaatagctcctattattgctgtttctcattatttttgaaactttcaatttcattgtaaagctagagaaacccacttctttgtgggaagtgagcccagatatgttttcagattacgtttccacaggagcagatgggcttgctgtgaatgctcagggattgcttaagggtaacacattctcaacttctttctccggaagcttattaaacaactctgaataactgagtgaaacttttcttgcatcgtttgtgcttgtaaattattccctttgaagaataacctaaagcttctgatatatgacaatactggtgaaggaaaacagagaattttctctccgtgatttattaattcttaat

SEQ ID NO: 8592 - DNA, 1193 bp, Homo sapiens
ttcctgggcaaccctactgtggccgcactgcgccttcctgcactgaagcacccctgcagggctcagtgaccaaggaagaatcagagaaagagcaaactgccgtggaaacaaagaagcagctgtgcccctatgctgcagtgggagagtgccgatatcgggagaacttgtgtgtatatggagattcgtgtgacatgtgtggctgcaggtcctgcatctgatggatgctgcccagagatcacagcatataaaatcatgctttgaggcccatgagaaagacagggagctctcatttgctgtgcagcgcagcgaggaaatggtgtgtgagagctgcatggagatgatctatgagaaagccaaccccagacagcaccgcttcgggatcctctccaactgcaaccacacctactgtcttaagtgcattcgcaagtggaggagtgctaagcagtttgagagcaagatcataaagtcctgcccagaatgtcggatcacatctaactttgtcgttccaagtgagtactgtgtggaggagaaagaagagaagcagaaactcattctgaaatacaaggaggcaatgagcaacaaggcgtgcaggtattttgatgaaggacatgggagctgcccgtttggagggaacggtttttataagcatgtgtaccctgatggccgtagagaggagccacagagacagaaggtgggaacatcaagcagatacccggcccaatgaaggaaccacttctgggaactcattgaggaaagagagaacagcagcccctttgacaacgatgaagaagaggttgtcacctttgagctgggtgagttgttgcttatgcttttggctgcagttggggacgatgaactaacagactctgaagatgagagcgacttgtttcatgaggagctggaagatttttatgacttggatctatagcaaccttgtgtggcgtgtgaactggtctgctgaccccagacagcagctgttccctgtggtggtgtggcagtgcctgtgttctctcctaggcaggcctgtcaactccaggtgctggcataagaatttttacccagggcctgtcttttcaacccctcacctttccccaaggagtgtgttgttttccctcttgaaaaaaagttagaaaaataaatcttaaagttagttttctgaaaaaaaaaaaaaaaaagaaaaagggaactagaaa

SEQ ID NO: 8593 - DNA, 1217 bp, Homo sapiens
gaatgacttaaataatgaactgcaaaagaaacaaaaagcctataataaaatacttagagagaaagaggaaattgatcaagagaatgatgaactgaaaaggcaaattaaaagactaaccagtggattacaggtaattttatatttaactctgataatgtctgatttacaatatagaggtagtagtttatttctactttatcattttatctatggtatttgttaaaactgactttcaaatcactttgattaatgtaattaatttcttttgtgacttctattgtgtttatagttctagagtagcatattagtatgttgtattaaaatgcagaagcagctaccagattatcttatgtattaagtgtcatttagaaagtatggtcagtgatagcttcagaaagttgctattatataattgaaatatttactgtctattttgttttacatttatttgtaaaaatataaagttacattttattttttagggcaaacccctgacagataataaacaaagtctaattgaagaactccaaaggaaagttaaaaaactagagaaccaattagagggaaaggtggaggaagtagacctaaaacctatgaaagaaaaggtatgtgaagaaacatactgacttatatgcttaaggtagtgacagagtaagttaaatacatagctgattaacagttaatatactgccttaatttgatgacctggctgtattaattctgtattaattttgaggactataagcagtattgaataacgtagaaaagtctaagtttctgttctgtaggaatttagagtctacttgaggagatacctataatgtaactcttatttggaaattactacatcaatttcattcatctttctgacattagagtacctctgaagttccttcacaccttaacatattcaactgtgtatcatttctctccaaagtaatcatttacacaggttggtgcttttgacttttgggacagaaagatagacattttaagataccccactttgacccaaataggtcctttttaatccttcaggagactaggctgttatttcagatagcaaagttatttggaatatcttcagtatttgcagtaataatcagtaaccaatctgctcatagattaattctgtgggagaaattgcttaaaattttatagttcatagtaaactgttttgtaataaaaattactgattgaaataaccccaaaaaaaa

SEQ ID NO: 8594 - DNA, 1152 bp, Homo sapiens
acaaacactaatttttgcaatttaggatatataaatgatacttgaatgaatgtgtagatagcagtcattatggggttttctataaaagactactgaaaatcctgtggatcataacatttcattttatcttaaaataaatacattataaatgtattagaaaccaatacattgttcagtatttatgtggattaaatttgtttaaaaggtagaataatgtttaaaaataaaattttctagtaatgaaagataattatgcaattataagatgcagaaactattaaatgtcacctataattccaggatgacttcaatgataaatacacatatgtaatgtaatgtatccgtatgtatgtgtatataagtatgaatacgtatgtgtgtgtatgtagatatatttatatatataatgtatatgtaaatatgcacaggtgtaaatatatgttacatcagtttgcaacaactcttgaaataactttgtcttttaggtgcaggagcttacagatcttctgaaatcaaaaaatgaagaagatgatccaattatggtagctgtcaatgcaaaagtagaagaatggaaggtattttttttcaattgacataataactttttctttttgtattttagatttaaattttagtcttatttttctttaaatgtcttatactggtttataacacgtttattagggtttttaaacataagtttattttatttattggttagaaaagctctagaactgtcctttttgatctctagctaatttgttattgaatgacctctttcacatcaatgagtttaactttaaactttttgatagaagtctaactccaaaatatatttggcatctaaaatatataattcgaaatataatttaaatttttttacttaactcatagttaccttatatacattagttaaatagttgcaggtttaattttagtttttctaactaaatgtcaggttcatcagtgggaatgggaataagcaaagggatcagaataacttgggaagccttttcaaaatacacttttcttcctcaccaccactctccaaccttaaccaaattgtcaggccttaccatattagaagctgggattatgatggttgtatacttgaaaaacatcagagattattctgaatgaataattctaatt

SEQ ID NO: 8595 - DNA, 1175 bp, Homo sapiens
tgagtgtgttattttagatagaatttcaaaaagtacttccactatttaactggatgaacctttattgtttaatttttgcttaaagatgtgaatatttacatttattaaagtttttatattttactatgcaagcatattctttacagaaaaccagtgagatatagctaattatgcttctcaaatttaaaatgctgtaatggtttagattttaatttcaaggagtaatcactcccaaacacacctagaaatcttgttttcaaagttcatagatatcctctaattttaacttttagaattcaagatttccatttcaccttgcttacgtacatcctgatgtttgttaatgtctaagttgccttctttatgtttaaattaatattcttcacagtattattaaaaatagtttagcagtacactatccaggttaaatgataaaatatttggattcaagtatcagatgcccatatatttcttaatttattataaattattttaaatttattataaattattaaatcttctttttttttttgtaggcgctttgtttaatggcattaccatttattcctgcatcgaaccttttttttccagttggatttgttgttgccgagcgagtattatatgttcccagcatggggttctgtattttggtagcccatggatggcagaaaatatcaacaaaaaggtgaatttaaatgtcagttcatgtaatgcttactatggaattaagtgtgacacattttaaaatttaaatatttagttcagttttctaagtcatgcttttgtatcttttggtttttcatctccatagtctcctcatttgtcttgtaagtcaagttaggaaagctccatggcacctacttattctgtgttcttccctatatttatgtaatttgattttacagcctgagacagaacaaactttgagtcagatccaaatgaaaacaaggatgttactgagaataaagtctcaaatgaccattgccacttccatattcagtgaactaagataatagtcatcctacttaagtgagtcatattgagttaatatatataaaatgcatatagtaagcaatctgtaatttcttgctatcatcactatcttcattataatctttgtatcctagttgcctcaaactaacagttaaggaacagcatagtcacactgtatatat

SEQ ID NO: 8596 - DNA, 1268 bp, Homo sapiens
cacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagatttttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggactttta

SEQ ID NO: 8597 - DNA, 1224 bp, Homo sapiens
gggaaagtgtttgaagggaagcctctaggtaataaagacccaccccagatccttcctgactgcagcagcatttaggattgtgattgccaagcacccaaagataacctgctgctctttgaaaaacaaatgctaaactgaaaacaactaaatagaattttttgtgctggtataatcatagaatatgctaaatcatagatttcaatgtcggcttgtgatagcaagagccaagcttgtgaaaataaagctgattcactgccacatattttgtgcttgtttctgtaattgagaaaaatctactattgattctggcatgctatactggcacaactggagaaacactgttcttcttggccaccaccatgggcaagaaaaacaaggccacgtttagagcattggacagaaccaggggtctcaccctttgttttaccttcattttgacatgttcgtttctgcgaagaccagaggagtttcccagtggggaggcctctgattatttgcgagtggtcagagtcccagctgccttatcttttgtctttaaacaatagagggtggagtgggaatgggtgccaaaaagattctctggtgccaaagcaataaaattctgcccatgggcactgggcagaagaaagctctagaatagaatacacttttatttttatttttattttgccttcattttaaaaaacagctaaattctcctagaaaagggagttcacttttccaaggtccttcttagaaaattacctagcagattctgtctcacaaatagcagggtgtgatcaaccacttagtatttaaatctaacgataatcaccaatgctattttaaactctttgaaactattatattgccggactgttgaaatttcctttaacttcctaaccttaaagaatacctggatatttctggtcttttacatttactggtaatgttattgtagaaagaataaaaatggcattgctgaattgttgccacacaccttcattcacttgaacttccatagcatttacataaactgtgggttgcttgtaatatttgagtttaaaaatcttcatttttaaaaaaatttttttatttttagctattatggatacataagagttgtgtatatttatggggtacacgtgatattttgatgcaaccatacagtgtgtaatgatcaaatcagagtaactggaatattcatcagctcaactttacaatttctttgtgttaggaacattc

SEQ ID NO: 8598 - DNA, 1185 bp, Homo sapiens
ataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatg

SEQ ID NO: 8599 - DNA, 2130 bp, Homo sapiens
actaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagcca

SEQ ID NO: 8600 - DNA, 1111 bp, Homo sapiens
gttgttctgtagtgtcttactaaaatattcatttttttacagtgtattgcaagttccactgcattacatgcaaatatgattcactcatacctagctgtttgtggattcaaactcataaatgaaccatttttaagttgttaatagtgtactgacatatttctgtattttctgatatttacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgt

SEQ ID NO: 8601 - DNA, 1239 bp, Homo sapiens
gatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagt

SEQ ID NO: 8602 - DNA, 1225 bp, Homo sapiens
atgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagtttttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaactagttgtattctgtgactataaattgttttgtctaacaaaagagagaacactgtattaaccattttgcattaatttatttacagaatattaggactttgcacttggatatagacagtggtgttttaatgttgttcaatttcgaatagtaattaaattcctgatctcaagagaaattattaatgccattttgccttagacattccatttaatattgtagagaattaacaaaactaaaaacaaatataaaaaatatgtaattaaccccttatttcattgtgtgtctgcatttaatacccagatgac

SEQ ID NO: 8603 - DNA, 1106 bp, Homo sapiens
aatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaa

SEQ ID NO: 8604 - DNA, 1213 bp, Homo sapiens
gaattaagtccaaatatgcccagataacttggccattgaatattttagttgaagagtttcaattttaacttcaaacagtcatttgaaggtttcataatggtttttggcagactgatagagaaaagaaagcatatggaattgggacgaataaggaaatttcagctttgtctctagggcaccttgctatccctaaccatatgtgtctttcctgctctggtggagaagaagaaagatctcacattgtgtcactttagctcaccatcatgatggtcactatccatcatttcagcattttgacctttgagccaattcatattacatagatgcttgtggaatcagttttattaatgtgtaatgaaatatgttctcctgcctccattcccgaagaagcaaattgccagtattttaaatgtaataaatcacttacatttattttgcactacttttgtaatagatttccccccaacttttcctttttttcagcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaaggtgattgatatctagtaaaattagtttatttccattgtaagtgataaaaagattgtcatattccatagtttttaaaaatagaagaatcttgagaaaagtgcataagcctctataggtatttaagtagccatttaaaaattaacctgtaaaacaatcagatagtcaaaattaatgtatcatatattttaaattactaaagtagtccattatctataccctagaagggtctttaaatgattttctaaaaaattaattacctctttgcaatctattccagatgtcttaaaggagaaggtgaaatagaaaagcttcaaaccaaagtattagaattgcaaagaaagctggataatacaactgcagcagtgcaggagctgggcagagaaaaccaatcacttcaggtcagtcacctatggatatgaagcagttttttagtctagaattggcttattagtgaaaagcatatttttaccttttaaaaaatctcatgtttt

SEQ ID NO: 8605 - DNA, 3310 bp, Homo sapiens
tccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaatt

SEQ ID NO: 8606 - DNA, 3310 bp, Homo sapiens; identical to SEQ ID NO: 8605

SEQ ID NO: 8607 - DNA, 1111 bp, Homo sapiens
taactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatc

SEQ ID NO: 8608 - DNA, 1189 bp, Homo sapiens
ctgtgatctgcattttaacaagcactccaggtgatttggatgcaggctaagtttgagaactagggccttagaagcctacagcaacaggcttttatggagctgaactatgatattatctgtctcagggaggcaaatgtgtgttgttaacatgtttacttcagctgggcttgctggaagcaaagaatctggtttgagttggggctaaggggggtaagggcacagatttctataaagcaatcaaatgagaaaaaggactgttgccttcccagggcaggatccctgctgtatgaaatccacctatttgggtttttcaagcagatgagcaatttgacatctttccactcctctgagcaacacagtgttaagtggatctcttgaaggatgagcctggtgcttggctgaagctgtcacaaagtggcatttctcacagtatttgcagaggccctgagaaatgttaaccagagactcagtttgctctttgatttcagtcttcacggttgaaaacctttcttaaatgcatctttttgccactttagaggctagaataaaaaccaaaagagcaaagtttgtgaaagattgttttatctttacaaatcagaatgggtttaagatgtagctctctaatgtcactcttactcacttgcattctgatttgctttcttgagagaaagagattgggatgcctggagttcctgttggctgctgggatttgcatgtgatccccgacatagactatttgtgacacacgctggtatgtgtgtctgtagctgatgtcctattaatagctgatacatgaatgtcatttgttggttgggcagacacaggaagtgtggcacgatgtaaattctgtgaagacagggctggttgattcaatgttttatccccgatacctagaacagcactcaataaacatgttgaatgaatgaaaaaaatgataattataattgaatcctggatcactcagaaacctacagattcagggtcaccagtctgagcattaattctcaccatctgggatcctaaatatagcatgtgtaggcagcactggctgcataatttgttggggccagtgcagaataaaaatgcagagcttcttgttcaaaaattaataactgtgagacagcattagcagagtattcagccaagcatgcagctcttctgagtgtggagtcctgtgctcctgcacaag

SEQ ID NO: 8609 - DNA, 1328 bp, Homo sapiens
gggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgc

SEQ ID NO: 8610 - DNA, 1271 bp, Homo sapiens
ttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttg

SEQ ID NO: 8611 - DNA, 1183 bp, Homo sapiens
aaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaa

SEQ ID NO: 8612 - DNA, 1736 bp, Homo sapiens
cccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaagtaccgtgttgggtttttttttttctttctcattcctgtgttgcatagattaagggtgtaaaattacaatagtcttttttttctttttggaacagaattaatagtaacagtgaaatggttactttcccaagtcaggataaatagctcaggcaggatgtctgtattaaatattgtaagacactaaagctccctgcaaagaccagttcaaggaccagcatgcatacccgagcccttcatctttaaaagatcgctcgagaaaatcctgtgctgtttattgaaagcattaagtcaggggacgagagggggtgtggtctttccattgaagccagaatgactgaagtgttgtgctcctaaggagtatgatttagtcttctgtccttttatcaatagcacatggtgtttatagaatgctttactgttttcacggcttttcctgtatgtgatctcatttggacctctcagcaatgctgtggggcagtgggcaaggtggttcacctccttctgtacagagattgagtgattggcccagggtgaatgaggttgggtgccggctcctgagcctttccaactgctccacagggctcctccccttctctcttgcatgctcattgaagaagcttgaatcctgctccccgcctactaggtgtatggccttggacaagttacttaccctctctacacctcagtttcctcattggcagaatggggaaatgattgtactcacctctgaggtctttgtgatgattaaagcaataatgtccgccaacagcacatccagatgcagctcattgtcagctttcaggaaatggtag

SEQ ID NO: 8613 - DNA, 1215 bp, Homo sapiens
tccttcccacatttacactgaacaattttgattgctcggagagtagaacttctggaaggttgctgatctcagggtatgtgggaagaggaggatggatttttttttttagctgctttcccagctgacttgcttttaaaatcagttttttttcctaggaggtgaggagaaggctagagtggtaggagactcactctaatcactggattcccttttctcatctcactgctaatccccctgataacccttctctccattcccaatacctctcctggcctgcatattttggaaagaagagggaggggactcagtgactgaggaatatagttcttgatagtctctgattataataagaaatgctcctgggtgctgctatttgttatttcctttaggggtcatctccaaggacacaccagcttgagggagcatttgcaaagggagatgcttagtatcttctgcttctctcataccttaccgcatttatttagtgggctttaatttatcttctttcttctcttttaagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagtagagtttgctctttatgtacaaactattttttcttttttctatataacatgtacttattttagtaatgattccaatgttgattatattttagaaactagttacaaatacactttaatagtgtacaatggtctactgaggtaataatgtactttatgtttttatagaatgaactatactgactcttgaattgtttttaaaaaaattaagacattaaaattctgacagtatagtattctgaaaaacctcaaagaaaactttttttattcattgattaaaccaaaacatttcttcaaaaatctattcttctgaatgccagagaacagaatgggttttttgttttgtttttgatgtgcaaaacttaattccttgaattagaactatcttggattttctttgaaaagctaatttatttgttttttttttttttttttttggtcttaaaatttgttactagtagacagtatggagtaaaactggtagggataaaatgattgtggtgatgttcaagatcttatatcctctggaaaaatttgt

SEQ ID NO: 8614 - DNA, 1200 bp, Homo sapiens
tacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccgtactggacaagaccacaaacaaatgtaaaggctatggctttgtagattttgacagcccttcagcagcacagaaagctgtaacagcactgaaggccagtggtgtacaggcacagatggtaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaatatttgtgcaaaatggacgggcttggccaaggaatggagacatgggcatcatggccttgacctatgaccccaccacagctcttcagaatgggttttacccagccccttataacatcacccccaacaggatgcttgctcggtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctgcctcagcagcacaggcatgtatatgctgacggctgcagctatgcaaggagcttacatctcccagtacacccctgtgccttccttccagtgtttcagtcgaggagagcagcggccaacagaaccaagtggcagtggacacaccctcagagcatggggtctattctttccagttcaacaagtaacagtgggatt

SEQ ID NO: 8615 - DNA, 1204 bp, Homo sapiens
aggttgagtcattactatgtcctactttctagattcttttgtgtgaattaagctgtgcagaggcagacagtacaatcgtaaaaatagaataacattttaatttagagtgcttggtggttgattgctaaccacttgaatacatatcttcttccttttctcattccttgctctcccttgtttctttctaaatcacaattacagagcctggcaccttaccagggctttgaagggtctgctcccagctgcacttcaggttctggcagggcgtcaagttgtgactttttttttgtacgcaagacatcctggatggctatccaaaggctgtttgggtgactagtgcaggattatctctggattttgaagaaattcatttctaatgttttgtttataagtaaagtaaatgcctggtgtaggtcctccctagacttttaatgttgttttttaaaaaacatcattcactttgagggcatgtagtatttaaaacattgttttgaaatattcaaaggcatagcatgtgcttttaatggaatgtgttttggaagctttccatgagcatcagcagctgtgcttttttgaatattttgaattaccatactttggggcagacattgtactactcactgcttaaaaaatacagtgcctatgcaaaataaaatgtcatatggaggtctgtaaagctgggactagtcaaaagaagtggtaggaaggacacgtggatgtgattatgtatttgtaatggttgcaaagagaagatgaagaatttggaaaaaggttgtactagtcttttaaaaactgcctttcactgagactagcccaacaagtgctcactgattaacaggccaatcgagataatgtttcactttttttcacttattgctgtttgaactctgtactttactttaaaaaattttcaatatgaatttctgtatttagtaaactgcacagtaggagacgttttattgtgtatttcaagcatctaatgtatgtgtaagtgtcttgcagataattgatagctgtgtattgactgattgaaatcaaagaagtctaaccatggtaggaatttaaaattgtgttagaaattttgagtttgataaacctttttataagtaaatataaatacaagagaaagccattgtattagttacttgtggctgctgttacaaattaccatataataggtgtctcaaaacaacaaaaaaattat

SEQ ID NO: 8616 - DNA, 1261 bp, Homo sapiens
atttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaagggagccagttgactcttgaccttcacaagtaggtaaccatgatgaagtaactatgtctggggatctgagtctcagcttttttgtgtctataaatttgattatattcatttacctatagttggacaagctaacctaccacctggacatcatagttttgactccccaaattggactgggtatccattctatgtgttctctgtgtgcctgtcatggtatttgtcacactgtactgtaattccctctgtgccagtagattgtttgctcctgccatacatatacacatgcacatacatactttttctgctatatgttacacatttcttttgatttattatttgtcatctacatttgtatacagaagttttaattttcattagccaaaatgctaatgaaatcacatagatattaaagggatacttggaacaactttatgccaataaattcagtaacttaagcaaaatggacaaattcctaaaaaaataaataaataaattaccaaaaatgacacaaaagaaggaaaagaaaatctaaatgtttcagtgtctgttaaaaaaattgaatttataagcaaaacacttgccacaaagaaaactccgggcagatgactgcaccagtgaattttatcagacatttaagggggacaaagtaccaatcctacaccatttcaggaaacagagcagggagaaatacttctatactcattttatgaggcaagcataatcatgccaaattatttttcctgataccaaaatttga

SEQ ID NO: 8617 - DNA, 1333 bp, Homo sapiens
tctgaaagtcagccaggcatggtggtggcatgctcttgtagtgttagctatgtaggaggctgaggtaggagtatcacatgagcccaggagttcgaggctgcaatgagccatgatagtgctacttcattccagcctgggtgacagagtgagaccctgtctccaaaagaaagaaagaaagaaaacgaagaaaaaaaaatacagtaatgagaacggtagctaacatttgttgcgtatctgccacacacaagaatttttctatgtgctttatgtctattatctccttttatgtttataccatccctgaggagtagggatgttcagatggaaaaaatctaaggcatagaagaattcagctagtaactgatggagttgaggcttgaacccaagcaacaaaatagttccagggctacgtttttaaccgtccttccactatgctgtactgcctcttcataactgtttgggttttttcccctctttaaggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaacaatgtctttcgtgcctttttgcccttcactttgttgttttccaactgcaaaatagatgcttccaaacatggtgattgaagtagacttgtattggggtagctgcctggtttacagttcccttttctggaaacagcctctgtggtcctgtttgtgctttgggaccgtaccttactaccatagctcattatatgggaagacctaagccaagccagattttctcatgggaatttggaacttgaatggagagacacgaaggctgaaagtcatcaaaactgggtggcttttattgacgctctctaaggaggttatcagagatatcgtatttcctgagtctggttctttaatggttcattttaaactgtaaactatcctagactctattccaatatattcttagttctttaagctaactagggtcacagattttttttgttgcttacaaataaaaaagtctttaatatccagattggtaccagaggtaggcaaaagaccttcaaggaaatgatgcgggatctttggaactggttgttgtgtctgggtagggtgaaaggcccacatctctct

SEQ ID NO: 8618 - DNA, 2399 bp, Homo sapiens
gaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaacatgttgttttttgttagatcaacttagcagaatgtagacgtccatgttgagatttaagataaatagtaagaaatctaagtttctgtttattgtttaggttttaattttattgttggtattttgagacatttttcacactaaaatttagtggaaagtactacagatttcccagacccccccccaataatatcccccttttccaagcctccccccatagg

SEQ ID NO: 8619 - DNA, 1244 bp, Homo sapiens
ttttttttttttttttttttttttagcgggagtctcgctctgtcacccaggctggagtgcagtggcgcgatctcagctcactgcagccgggttcaagctattctcctgcctcagcctcctgagtagctggactatagatgcatgctaccacgcctggctaattttttttttttttgtatttttagtagagatggggtttcactgtgttagccaggatggtcttgatctcctgaccttgtgatctgcccgcctcggccttccaaagtgctgggattacaggcatgagccatggcgtccggcctcttgtatgtttttatattgaaataagtacaagcaacgataccattacaaatagctcaggagtttttacagttccattaaaatgacgtgctaaaatgtataacgttaaaaatagtccttgaaattagaaaagagtagactctggttatcttgaccatgtaaatttttaatgaggtattaagaagtgtgtaacagttgaggtaacaacttgcataggtattatgaacaattttaaacatagccatttaatattccagatgtattttcggcacaaatgatttgtctattcagtgataaaagtctcactgcacctcactatcagctaacccagatgacttgttttgtgaaatttaagaaaaatttattggtagagacctctttcaagtttgtacttaacagatgatcactagtggtgaacagcattctacaggatactatctttcactaagacttcaacctgcaaataaacccacttataaaaaagggatacatgatcttcctgtggttaacagagcttagatacatagctggtctacagagattagttgattctaccctctccaaataagataaagttagcagcaacaggactttaaagaaacccagtgagattatcagaagaagaaaaagagtgactcacactgtatttttttttgtgcaagtttagatagatagcttttagtttttttttttttttttaatgctcagggccagtgttttaagaggctcctacctagtagtcacataatcctagcaagagtaaatcaagctttagttatttagaatgagatgctagacataataatagtccagttgccaattttgaacacttatcttttctgccctataattttttctcttcaagactctattcctttgaactaaaaaaaatacataaagttttaagagatctaatgtcatcagacattataaaatgaactcat

SEQ ID NO: 8620 - DNA, 1184 bp, Homo sapiens
cagaaattctatataaattttagtgttttcatactcttaaaatcttgattaaaaaattttttttaaaagcagtttttaaaaagaaaggctttgaggctcactctcacatacagggctgatatttagccaggagatgagaggactctgttcaaataataaaatccttccatgctgcttggtaaatagccacgggtcccagccactctagcccttccctgtaacttgctgcaaaatgtctgatctgccagtataaaggccagtctctggtacagaaggaggtctctgggaccctgtggcaggaccatacccatctgattggctgggactggtgccttatttgggtgatgctggctgtcacccctgctgacatcctttaatttaatcttgggtattgacttgtgttcttattctctttctccttcctttttcctttcctctgaaccccttccctcctttctttcttctctccctccctttctcctcctctgtctccttctcgcctttctttcttttcaattttttcttttttggcagggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaaattttaacaaggtttaatcttttgatttacaaattaaaaaattttgaattagctttatattaattttctctcagtatgatcacaaaatatgtcaaggtagtattttacctgatatatgatttaaattcattaatttgaatctgctgcagattcaaaaattcaacatggttaggattttgctttgctttttaaataaccttaaacataagtccgggcgcagtggttcatgcctgtaatcccagcactttgggaggccaaggcgggtgaatcacctgaggtcaggagtttgagaccagcctggccaacatggtgaaaccccgtctctactaaaaatacaaaaattagctgggcgt

SEQ ID NO: 8621 - DNA, 1228 bp, Homo sapiens
agaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcaga

SEQ ID NO: 8622 - DNA, 1674 bp, Homo sapiens
tgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattcc

SEQ ID NO: 8623 - DNA, 1127 bp, Homo sapiens
tgccttattttaaagacactgccccagatcagagtttttgtttttgttttttttcaaggagagatgggtgggaggggggttggttggttgttttgccagaattttataattaaactatgtaaaccttagtaggcctgtaagtttatgaggatatgtttttttttttaagtcattttccacagtaaatcaactgttactgctaggaggaagttactttttaaaaaatatttccatagatactgttagactaaaagaaataggtagatgcttcaaatagaataataaactattaaattcagaaagccactatatataaaaggaaaaagacattgtacttaagtatgcaattactttctttttcctgttacaatgttctaggccagctgcttttctgcttaccatcatttatgcttatactaaagcatgtctcatctttaagactaatttttatttatttgtttctgtagctgtttctgtaccaaattctacgtggtttggcatattgccatagaagaaaggtattgcatcgagacttgaaaccacagaacctcctcattaatgagaaaggagaattaaagctagcagattttggtatggaatgtatgagatatttattagtacttccaggttctaaagtgtaatggttaaaagatcaaccactgtcataatgtgccattgcttttatgtgggtttggaaattttctcggtagcccacagaataagatatttgacagaactttggttggtgatttatgttggttattagcagcaaattctaaaatgcacaggctgttcttgggtgtggacaaagacccctagggctcctgagacccttgtaggaggcctctaaatgtaaatatattaccaaaattgtaccatctgttatttgcctatttcactgtgttaatatttgcaatgatggtcccaaaataataatgcataaaactatacatcaaagtagtggcaccaaaatatatctttttttttttttttttttttttttttgaagacagcattttgctgttaaagcccaggctggagtgcagtggtgtgatcttgactcactgcaacctctgcctcccaggttcaagtgactctcctgcctcagcctcccaagtagctgggat

SEQ ID NO: 8624 - DNA, 1278 bp, Homo sapiens
tggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatacacataatgtatattaaaagaggtgggatgaaataattttagtaattatgtgtacagatgaaacatttttgtcatggaatttaaaagctaagtaagtataaaaaataaaatgttatatgcaaaaaataggaaacatgaaattgaaatttcattgttggccaaaatgatatgagagatttaccttc

SEQ ID NO: 8625 - DNA, 1416 bp, Homo sapiens
tacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtgttgtgtggtctccagaaacatgttgttctgtgtgctttattcttggagttgcaacaagttaaatatttgtatatgaacaccccttttccatttcatcattgaaactcactttgacatttcagtggtataattgaaaatattctgattatggtatggtttttcttctgtttgaggaccatgtttttattgactgttggaatctaaatttataagaggaattaatctgtaaccagataccttattcgtttaaccgatttctattccactactaatggttttttttactttgtgctttctagttcttagattctgagttaacaaagcataaaatagattttatattgctgggggttgtaccaaacatagatacattgacagatccattgatagaagtgttgggagatggacttgaaatcttagtcctaaataaagactgaactgtttaaactaacttgataaaaatcactgttcgtttttgggaacctgcaagtattaaatagattctgtacta

SEQ ID NO: 8626 - DNA, 1820 bp, Homo sapiens
gattgcaggcgcgagccaccatgcccagcccatctaacttttaaaatagaaaatatgtagaagttttaaataggttgactgacctcactgctttatatgtatcaattttctactgttacctcagggaatgtgcttggaattaggagtggcaatgacattttatgttatttctctaaatcatgcctttatctaaaattatttttcttttcctcctttcactcccaacagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctactaaaaatacaaaaaaattagctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacat

SEQ ID NO: 8627 - DNA, 1213 bp, Homo sapiens
atggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatgtgatatttatggattattgtgttttatttcagtctgttcatatgttttacttcttattgtaatcgggttctcgtttat

SEQ ID NO: 8628 - DNA, 1131 bp, Homo sapiens
atagcaatatgcttggagaggtatgtaattaactttaaaattgaatgttccgagtgtttaagactttccgagtgttcttagatttttgtctgtcttgccttattttagcactgaagaaaatggtcctacaaagtgagcaacttgttttaaatcgtatgcctgtgtcagcagagacaggttgataaatgtatttcattaaattacaattctccttttaatatactatcttgttttctaagtaagttggattttgagttttttagagaagggctctgggactcctttgcgtagttccggggcatggcatctagatattttttgaatattcatgttgttcacatagttacgtgttttgttaatgaggttatgagaccacatatatattccatatcatcgtgtgttactttataaaatgtctgaagcttagttgttttctagaactgtcacttcaattgaaaaccaacacaacagcaattcacatcccttccttgtgttttggattttaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcgtaagtaaacacttaaaaatttatactatgaaagtacttattttaagtgaacttcatttttttttgtttttttttttgttttgtttttttgagacaaagtctcgctctgtcacccaggctggagtgcagtggcgtgatctcggctcactgcaagctccgcctcccgggttcacgccattctcctgcctcagcctcccaagtagctgggactacaggcgcctgccactgcgcccagctaattttttgtatttttcagtatagacggagtttcaccgtctccatctcctgacctcatgatccgcccaccttggcctcccaaaatgctgggattacaggtgtgagccaccgcacccggcttcttttttttttttctttgagacggagttttgctcttgttgtccaggctggagtgcaatggcactatctcagctcactgcaacctc

SEQ ID NO: 8629 - DNA, 1398 bp, Homo sapiens
tatgctttttaggattcataaatacttgctaactagttcctaaaagggctgtttcatgggatgtcattattaggcttgggaatgtattgatcttactgttgcaccatttttttgttgttgtttattaagaattttatacagaaagtgttgaataaaatctgaaaaactttaaaagattgttccgttttacataggatagacagcttgataactgtacccgtgtcaccctgagtctgatttttattttagaactagaaaaatattattttaaaatcataaaaatgattattggctctgtgaagttttgtttttaactggcactgtatgggatcctttatcttttttcagctggagtcttttgtgcaattgtttctcaccctgctgattctgtggtatctgtgttgaataaagaaaaaggtagcagtgcttctctggtcctcaagagacttggatttaaaggtaggatgatgtttttttcttgaaagaaagaacaacagttttggatatgttgcatttttttcatttgcttttcctgtttgaaccaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctgactttttttttttttgagacggagtttcactcttgttgcccagacgagtgta

SEQ ID NO: 8630 - DNA, 1174 bp, Homo sapiens
tgtgtgtgtgtgtgtgtgtgtgtgtgtgtctgtctgtctgtctgtctgtgtccagatttcccttttatagggacatgagtcatattggattagggtccaacctaatgacctcatcttaacttacattaactcaaattagagttcttggtgcccttctcccatatcctttccccagctgcaacctgttaatcttttggtccttacctttttagtaagtggcactaccacccacacagccaaaagcttggcttcttttgattctaccatttccctcaactcatcctcatacatctgcaatccttcagcttgtcttattgcatatctctacatgtatttccaatttatcaatatcttttcgttttcacactcctgctcagtatgaacaacataatttctcaccttcagtagcttcctaacttccacccttgccttgctctcatcagtctttttaaagagaaaccaaatttctacacacactggaagatgggggtcctctttccttgcttaatgcagccatgacttgtgatcccaagaagcatctgaagtgggtagcagctccaaagcattggatgctggataagttgaccagtgtgtttgatcctcgtccatccaccggtcccacaagttgagagtgtgtctctccctcatcatcttcctaaggaacagacttaagtatgccctgacaggagatgaagtaaagaagatttgcattcagcagttcattaagatcgatggcaaggtccaaactgatataacctaccctgctgggttcatggatgtcatcagcattgacaagacgggagagaatttccatctgatctgtgacaccaagggtcgctttgctgtacatcatattacacctgaggaggccaagtacaagttgtgcaaagtgagaaaaatctttgtgggcacaaaaggaatctctcgtcttgtgactcatgatgctcgcaccatccactatcctgatccccttatcaaggtgaatgatatcattcagattgatttggagactggcaagattactgatttcaccaagtttgacactggtaacctgtgtatggtgactggaagtgctaacctgggaagaattggtgtgatcaccacagagagaggcaccgtggatcttttgacgtggttcacatgaaagatgccaacagcaacaggtttgccactc

SEQ ID NO: 8631 - DNA, 3194 bp, Homo sapiens
gccagaaaaaggagagaggctgagaaagtaggtgtagctcagcaatgtctaaagccatagagaggtccaggaaaattcatatgaaatgaagtcactattagactaggaaattaggagttagtattttgtattgctgggtcaaaacatgggaacattttttaagtgcttgatacatgtttccaaatgttgtctcaaagcagttttcagcttaagtgcactctcaccagcaatgggcatttttactatcccaagtgtcatacctttggatactatataaatagtctgtatttcctgaaatgattaaattatcttatccccccgccatttatcatttcagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacaatggtgtgatcttagctcaccgcaacctccgcctcgtgggttcaaatgattctcctgtctcagcctcctgagtaactggggttacaagcgcccaccactacgcccagctaatttttggtatttttagtagacacagggtttcaccatgttggccaggctggtcttcaactcctaaccccaggtgatccgcccacctcggcctcccaaagtgctgggattacaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatc

SEQ ID NO: 8632 - DNA, 1919 bp, Homo sapiens
aattaaaaatttttaaaaaacatcttgtctccacagttccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaaggtatcatacaaacaagtagtagtaatgatttaattttgttctttttattttatgatttgtgcgtatatgtatgttacattgattattaattcatgttatgttttttaaaaagattctcttcttagtggtcatgtaagtcccctttactcaatttaataagatttgaggggaagagttagtgttttacgtcttaataggaaagtagtattttgggggaaaggtcaagaaaaagaatttctgagctaagtcatgttcttttatcttcaagatgtatggatttgccagttggatgagattaatttttcttctcttctagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaagg

SEQ ID NO: 8633 - DNA, 1189 bp, Homo sapiens
tctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaattgagcagttgtatcttctgaccaccaacagattttcagcttgccatgatagtctgacctcattaattactgctactgaagttcaatttttttctaggaattttaggaaccttttgtttaaatattttaatttctattagccatttttaggaaggaaagaatcaattctcttaacaggaaacatgctttatttttcaaaacctttctctgatatttttctttaatttgctgattattcaaccacagagccttatgctataaatgtcatttgtattttaaaaaataatattccactcataaaactttaaaaccatctttcaacgaactatatatgtattatagttgctgccatagagttgatggtttttaattatctggaaccag

SEQ ID NO: 8634 - DNA, 1137 bp, Homo sapiens
gtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaaggaagaatgaatgtgttagcttcacatcttaaaagtttctcctatttgtgtctgtctaaataggtgcagacactaaggatagtgaggatggaggctgggatgaggaaagggttcatcagaattcacatatctgaattcactggaaagagcccttctgaagcaaacagttgtaaaatcactgcaaggtttttattaataatagacatgtatatgattttcagtctatagcatctttgttaacatctgccttttgcaggaaatgtaaaagttatttaacactacaagaattttaacaatagttgctctatttttgaatatgtattaaatatggagttcatatacctgctaatatcaacggtggtgctcttactattagttaattgcattttggttaaaaaaaaaaaagcaacagtttggcacttgtcctacaaaaggcacctaatttaattttctgatcaggattgcctgatccaacagtgctaagtcatggctgctgctgactagcttggcattattctgtgttaggtagaattcttattatttatttttttaagctttccaaattggaaggaactgattgtttcatgtggcttatatttacattggtaatattttgtcaccaatatttttggttaaaaaaaatccaacaaattaacttactgaaatataaacaaattttgtaaacaattttttatattatctataaaaacgtagacaccttatgtttcacatgttgtgcaatgtgacaggggaagctgatttagtagcttttagcatattaaaaataattttttataatgtaatttcctgtgagtgcagacctgacattttacattaaaataatgtgaaacatcagaatta

SEQ ID NO: 8635 - DNA, 1247 bp, Homo sapiens
aaatatagaaaagtgcaaaaggtgtttacgactccacattgagggataacctaattgacattttagttatatcctttcactcttttttttttttctatgagcaatcttaaaatggccataccacactttttattttgtgattttttttttcccttagttctcatgcacacgaaatggaaaataagcaattttggaaagtctactatgagcatctagaaaaagcagctacgcatgctggtatgtaaaggggttgtgaggaagctgcgaagaaaagtggttgtttaactgttttgtttttattgcttaattactcacgaaattggaaaacagagatgaaacatatattatcatgataacttttgggagtgacattctttccttacattatagagaaagaaatgccctctcttgagaaaacacttaagataaatgttgatatttgtctggtggttatgacaactttctttcttgcagagaaggaactacagaatgatatgacagatgagaagtccgttggagatgaaagttgggagcagacccaggaaggagatgttggagctctttatcatgagcagttagcattgaaaactgactgtcaggaaagacttgaccacaccaacttcagattcctgctctggagagctctgaccaaattcccagaaagagtagagccacggtccagggagctttccccgcttttcttgagatttatcaagtaagtttcctcttctaagaatatgtccctggtggggcatgaagaagagaatgtgagaagtattaacctcccaaagtggctgagttctttgttttttgccttctttctttctgcttccaatcatccattaggctgaggtattttttgtttgtttgtttttgtttttgttttgttttgttttgtttttagacagagttttgctcttgttgcccaggggtgcagtggtgcgatctcggctcactgcaaccttcacctcccagattcaagcgattctcctgcctcagtctcccagagtagctgggcacaggcatgcgccatcacgcctggctaattttgtatttttagtacagacggggtttctccatgttggtcaggctgttcttgaactcctgacctcaggtgatccacccacctcggcttcccaaagtgctgggattacaggcgtgagccaccacgcccagcctaggctgagttctttatacatctgtcacgttttcaaatcattggcacagctacaaagcactggctctat

SEQ ID NO: 8636 - DNA, 1173 bp, Homo sapiens
tcttatcaatccatacctggaggactaaattttgtggtggtactatattttcaagagaactttggcaaagtagaatgtatctgatggaaagtgaccagcacagtcctaatgctatactttaatcatttaatatcatccatccctaacccctcatcccccagtggtggttccagagacagggaggctgatttccacttagtccaaaatagacatttcaaatattttcaacagtataacagtggaatgggctatcttctacagttagtgaatcgcttgtcaaatagcatactaaagaaggaccaagttaggaaagagtaatattgtggaagcttgcctaaggtaccactatgtctcttcagtgtgtgattctgtgaactgtggacatctctcatgaacagaatcagcacctttcagattggtgtgcgttcttcatcagtatcctgtgactttctttccacggtagcaatgagtattacccagcagatctgcaagttgctccaacccaggatctacggagaaaaggcaaagggatggtggcagaggaaatcgaagaggaacctgccgcaggagatgatgaagagttggaggaagaggcagtgccccaagatgaatcctcacagaagaaaaagacgaggagagctgcagcaaagtaagttcaccattgctgaaagatcacagatccacagttctgggaggaacaggaagaggtctcttacggctttatacaaaatcaactactcagataattatttacgtaagcgctacatcttcctgggattttctttaacagcctaaaactgtcaggcttccaagttttttggttgattacttattagttttttcttggttagctacataatgttagattgggggacttttgagagtcatctaattgtagctcctttttatagatgagaactttgggacctggagtgtttggatattcttttgacctttgtcgtgcactttcccagcgtgagggtattgtgtttgcatgctaggggaacatgtaatggaacatcctttttcttaaaaataagcatgttagcaatttttttttccttccacccaccttccccaccatcctgttagcacttttctctgccttttaacttgccttctactggttacttttttctcatgctgttgttatactctctttcttattctttt

SEQ ID NO: 8637 - DNA, 1193 bp, Homo sapiens
tccgcctcccgggttcaagtgattctcctgcctcagcctccagagtagccgggattacaggcacatgccaccacgcccagctaatttttgtatttttagtagagacggggtttcaccatgttggccaagctggtcccgaactcctgacctcaagtgatccacctgccttggcctcccaaattgctgggattacaggtatgagcaccatgcctggccaccagtcactttggatctaatatagctgtcaggttttttttgttttttgtttttgagacaggggctcactttgttgcctaggctggagtacaccaccacacctggctgatttttgtattttttgtagagacaggatttcaccatgttgtccaggctgtcctcaaactcctgggctcaagcaatcctgacttttttttttaacagtggaaatattttactttttaaaattttatgtttttttctgtttcctcatattagaaacaaattctttttaaaataaaatgttttttctccacttcatatttacagagtattcagcaggattataccacaatactttcctgtttaattcaaacctttccaaaccaactggaattcaaagacttggtacaacttactcattaccatgacccagaaatggacttctttgagaacatgaagcacattcaggtagaagacaattctgctttttcctacctacgacataagcatacatatttcaaacagttctacctcatttggaaagacatgttttaactttccaaaaaggtttaagcttctctttccttggtctttatgatcatcattgaaatttgtgttaagatgatcatttcctggattctaatttctttggtggtatcacaaaccacagttaataatagtgtcgcttttctctgccttttcctaagaagtgtaaatgctttgggtccattgttaaacaaatgctatggattatatctctgaaagcaaatcaaggcacaggtgtttgctcttgtaacacatggactgtgtttcacttccttaatctttgtctttttttttttgagatggagtttcgctcttgttgcccaggctggagtgcaatggcgcaatctcagctcactgtaacctccgcctccagggttcaagtgattctcctgcctcagcgtcctgagtagctgggattacaggcatgcaccaccacacccagctaattt

SEQ ID NO: 8638 - DNA, 2039 bp, Homo sapiens
aattagcttaagactctcttctgaagagcttttcctaatgtatctctattcctactgcctaatcactcacttaaagttagatgcccttgtcacagattagtgacatagtacttgttttgctgtcttgtaagtttgatttgttcatctactcattagataatcacctccttgaggattgagactagtttcacctctgagtcatccatatgtagcccagaagtagtagtagcctggaaaataggtatttggtcttttttgaatttttcattcaaatcatagacaaattcaaagcttagaggaaccttatggatatctagtgcataacctcatctgtgttagctgtcatcattttaagtactttggaatccacctccaatacaaagtttattatagatgatcatgctttatacctgaaaattaattttataaaacagttcattttctctttacaggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctct

SEQ ID NO: 8639 - DNA, 1238 bp, Homo sapiens
attttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaattt

SEQ ID NO: 8640 - DNA, 1156 bp, Homo sapiens
atatttattatgggatctgagcgccatcagccaggtaagggatgcacagaagcttttacagcccaaatcaaaggttaagatgttaaaaatgtgtaagttactatattagaagagggaaggggacttacagagaggtgagttgattggaatttttctaatttttcagtcactgccattggtttggtattaactgaagtcacctagaatcagatccaagaaccttcttcataaagtgtgttatagaaatgctgtctctttgaattttgggtttaaaaatatatatactgaatcttttgcattttttgtaatgtttaaaattaggactccatctttaaaagtctgccagagcaccttgagagcagacgggcagaaggaaaggacaaagaggaggaggtatgacttaaggggtatttcacatcttcatatgccaagtgtttttctcagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggtacaggactttctaaaaattacaagactgtgatttctaattctgctcttttagtgtggtacagggatttccataatttcattccctttacccttctacctccatttcttcctttctctagctcttcattgccttcccttccttcctttcaaaaactaaaccaaacccaaacagctctcattcactctctttttttgtttgttgttgttaaaaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtgagtgcctaagaggaggggggttgtctagcgtggaagtcacttagcaaatcagaaaatgagtgcacatactactgtagtcaaatatcaggccagacatggtggctcacacctgtaatcccagtactttgggaggcggaggtgggt

SEQ ID NO: 8641 - DNA, 1214 bp, Homo sapiens
atccttatctgacattcttggaactagaagggtttcagattttggaattttttgcattttgtaatatttgcatatacatgagataccttgggaatgggacccaagtctaaacatgaaattcatttatgtttcatgtataccttatacacatgacctgatgataattttatataactttttttaataattttgtgcatgaaacaaagtttgtgttaagtgcttatatgtggaatttttcacttgtggtatcatgttagcactcaaaaagttttagtttttggagcattgcagattttcagatgaggaatgctgaacctgtatattgcaaatgtttacattttaccgtacaacagtgaatctctgcttacacttcaggtatagttagtgagataagtgattgagtttctttttatttttctgtcttacagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccaggtactttcttgatatgtttgtctattacacaccaaaaaaaggcagtaactgttgctaaatgatccactcatccatcctgttatacctgagactatgctgtcaagcgaaagcaagtctttcctatagaaggccagagctatggatttttatataacataaacttgctatgcagatttactctgggagtaacccagaaaggacagtgcaaaagaggaaatcttggatctgtgcaatgttgacttatattggaaaataagaaaaacactgaccctgttgcatgatggttccctgcagtggttctaagtcatgtctttattgtatttcatctgttttaactgattgcttgtttaggatttattatagtttaaacacattggacattctgtcctataaagagaaaatactgtttaaaccttaagttcacccacttgagtttaacacataattcataaaatgcaaaatattatcttttagttatcctcaaaataagagacctgttcacatggatcgagcctgcttattcaggtaatgtaccgtttttgttggagctgtgatttgatcttttgacgttgctgtgccaccactgggatacttttgtagttct

SEQ ID NO: 8642 - DNA, 1540 bp, Homo sapiens
gttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccacttacctttgaaactttattttcctcttcgttcatgaaactgctctcatcatttttatattgttccagggaaggagcaataactgatttttctgcagtgtcttccttctgaaagcctttccccaacctgaatgtattaaataccatgtcatcatctaaatttcttatggacttggatgctgaaagtaaaataccttgagaaaacaaagaaaaagttagtattaatatataggaagagagattcatttttgccattcttagtttgatgtttgcatacagtcaaacaagaaagaaaatgaaaaatttctctgtcagcctgcttggtaaacgattctgtatctttatatattttctagcttgaatagaaagcacttcaaagaattatacttttcatcattttagaaatgactcattagattgaggctaacctttatgcagctgctaatacctacattgttttggttttagtgacacattgtttattttgagtgtgaattttctcagaatctgactaagatccttggtagaatgctttctgttgagtagattatagtctcttgaaaatgggttgttattaaggaagaccacag

SEQ ID NO: 8643 - DNA, 1728 bp, Homo sapiens
tagtggggaaaagggacattttaatggcaaaacctaagttagggccccattctctacttgaaactctagacatttttaactgaatttttaataaaaaattactgaggctttgtagaaaaagatgagaatggggtagcatagagtagttgcgctagccacatttcaagtgctccagtgctgcatgtggctagtagctaccatattgaacagtgtagatatagaacattttcatcattacagaaagttctattatacagcactgctccaaacagtaggaactctgaacattgagctagataataagatataatcattttatgttttgtatccacagtggggaaatgtaaggaattgtgtcttgtaattctcttatactgtacctttatttgctcaacagatgtttgttttgcctctaataatatataccaggcactctactaggcactgggaattcaggggtagacacaatagcctcaggcctttctgtatggagcttgtattctcatggaagagcagtcattaagtagataatcatacaaataactatagtctctatagtgctggttgtatagtagatgtttaaatgactgttgattaattgactaatgtgtacagtcccatcatcttcttagatactgacaaatcataggaacaaaaagctagctagtaatttatagttaaggtctgcaagtaacattaaaatttcagtgcagtcaataaatttagttctgttcagactgtttttgttatttttcttatttttgacatagagcaaagattatgtcagttgccctgtggtttaaagccacagttattctagaagcacagttgccatcattgagtagtagctgatccaaaagaattccagccaaggtcttgccaatgatggaaagaaatgatgtgtcctggaagttgccaaaaattatgtttttcttgttgaagacaatctttgtatctttaagcccttcatatgttgtgacatgagcacatatgaatgttccctaaaaggcaacaattatgctgtcaaattcattcaagcagtagttatccctgtataatttgaagttatacagatgcctaataagtgttttgatgctgttgctactgatgttgctgatgacattacatagaaagttgcagaagataaaccatgaagattgacactttaccattattattttgattttgtttctctcttcacatcatcaagtcttgcttatgctgttaagccctagcagttctttaatatggaagggggtatgacatataatttccacctctgagaattattttctttttgttgatttttgcaacttcatccagacttctctaaaatggtgtatctgtgtgctttgtattgttggacactgacactgttgatgtaataatcaggggcttattgtaccagttaataattagccaaactcaggaggctgaggtgggaggatcacttgagcccaggagatcaaggctgcagtgagtcaagatcagatcactgcactccagcctgggcagcagcaagaccctgcctcaaaaacaataataacaataattataataattagcttagtaatagaaattcaaagtatgggtgtttaaataaatcagaattcagtttttctatgcaaagagaagtgtggaaataaattttttaacttcccaaatttttaaacacaagattttttaaaaacttgatcatctgataaaatagcctatacatttttaggg

SEQ ID NO: 8644 - DNA, 1330 bp, Homo sapiens
gggagctgtagtttctcaccaccgccacccccccgcccccccgccatctgaaagggttctaggggatttgcaacctctctcgtgtgtttcttctttccgagaagcgccgccacacgagaaagctggccgcgaaagtcgtgctggaatcacttccaacgaaaccccaggcatagatgggaaagggtgaagaacacgttgccatggctaccgtttccccggtcacggaataaacgctctctaggatccggaagtagttccgccgcgacctctctaaaaggatggatgtgttctctgcttacattcattggacgttttcccttagaggccaaggccgcccaggcaaaggggcggtcccacgtgtgaggggcccgcggagccatttgattggagaaaagctgcaaaccctgaccaatcggaaggagccacgcttcgggcatcggtcaccgcacctggacagctccgattggtggacttccgccccccctcacgaatcctcattgggtgccgtgggtgcgtggtgcggcgcgattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcggtgagtgattctggaggagcagacgtcccccctccacacacgcggccgcttctcgaaggtcctgggggcgttgaacgtgggaggggggatcccggggcctgcggtgggccaagggacgtcaccattcctcgaaagagggcaagggaattacgtttattctcttcttcctctggaaataaaaaaagagagcaacatcatctaactgccctacagatctaatagtatctcgcccggaggtctcagcgacctcggggtggggcctctctgaggctctggctcccccgggagctgtgcgagtccctcccccctccccgcccggaggactttttcggccaccgcaaccttcggccatcccagctttcccgtcccctaattccccagactccgactcctcgcaagcccgtgtcccttcttagatgctggcctcgggagcgtgaggcctggggccagcggaatggcagtgtcagcgtgtttgattcagttttgctggagttcggttcttaacatttctcccccttctcatgcctctgggctcaatttcagttcccctcgccagaggttgcataaatccta

SEQ ID NO: 8645 - DNA, 1330 bp, Homo sapiens; identical to SEQ ID NO: 8644

SEQ ID NO: 8646 - DNA, 1099 bp, Homo sapiens
ccataaactttgtaagactttatagaagatactttcagttggatttgtattcattaactgtgtacaccgagtaagtttaaaaatgggatttctgtcagttgaacaatattttaaaatttggcctcttgggacttattgacagttttgaagtcctcactgtggagcataaatgagtatgactttgctttttagtagaggaaagttgggatttttttttttctggcaattttaagaaccgagtatttccagtgtaatgttaaaggtagcctactgctgtgctaacataatgagacggtatatcagttatattttataaaggtttccattttaacccccaagacaatattcagaggcccctgtgctttcatcataattcctctagttttgaagggaactatgccatgcaatatttgcttacctaactgatttccttagagaggaagaagctattcagttggatggattaaatgcatcacaaataagagaacttagagagaagtcggaaaagtttgccttccaagccgaagttaacagaatgatgaaacttatcatcaattcattgtataaaaataaagaggtaagcaacatgtggttagaatattttatctctgtatggtggcatacttgtttacttaaatttgcttaatttactgcaaaagtaatgtagtatccaagtaagtaggtaacaacctttaaatacctaatatgtccaagaattgctaccagatatctgggaagaaagggagtgtcagacattttccttttcctttacctctaaataggttcacggcctgataatagttgtgagtctaagggcagtcacataaactaaacttcttgcattgcatacctgaagatcactgttaggtgaataagagtgcttttataaggtacagagaagaaataaatgggtttggcataaaatcgaatatcttaatgcatcttgaggatagtctaagtgtattccctctggcttccatttagattttcctgagagaactgatttcaaatgcttctgatgctttagataagataaggctaatatcactgactgatgaaaatgctctttctggaaatgaggaactaacagtcaaaatta

SEQ ID NO: 8647 - DNA, 1353 bp, Homo sapiens
cctgaaaacagagctctcctttacaactcattggccatttataactcattggccaaaactagtcacatggccttagccattcttaaatggaaagtagagtactcctaagtttctggaaggcagacagccaggaatattgagtgaagaatattaatgatccatcacagattccaaatagaggaatcattcaagttgttttgtattctagtaaagaaataggcaagacataaaattttatttttcttgaattgttttccttcaaaggtaacttgttttatttaggtcagcctctaacctttgacatttaggccagtctgcccatttgatattaatactttctcaaatacataaattactttaagatgtacactttcagaaaaggccataaaaaactatgtggaggaaaatatctcagtttagttttctgtattggaattgatgggacccaaagctggttagttcctcaatatttgtttggcataatgtaaatattaaatacaactatctggttcttgtcttgcatttagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacgtgagtatgaccaattccttataagaattaatagtcatggtgaggatcttgactctccagttctattctctgagcaaatgacttattctgggccttaattttcctgccttataaaatgaggaaacagaactgttgtcacttgaagaaatgtttgaggacctgcaaagggccaggcacaaaggtttgtgattgctgttgtacatggagggtataaagtaggaaatagcagcagcttccccaagggagaaggcttcttgggtacccacagaggaggcactgcttggtcagtttcccaggttagaagagtaatttgtctgtggagcatcctgaataaaggcatggaggcatagcatgctcactagatgaacagagttcttttcggtggcagttatggatagaatgtgatgaacttttatttatttatttattttgagacggagtctcactcttgttgcccaggctggagtgcaatggcacaatcttggctcaccaca

SEQ ID NO: 8648 - DNA, 1109 bp, Homo sapiens
taaagaattgtacaggtccaggattaacattttgtcatctagacacatagccacctttttatcaagcctttcattaaacctttcccctccaatacttccataattagaagactctttagtttttgaatttaaaagtatttgaaagtagcatatttgttcacttcatttagatgctagagagagagtatcactgagtcctaaggttagaatataaacattaaggcaatcttgtggctatttgcacggacagctgaatttcagcccaatctgaatgaattggagtgcttcaccatttcctgcccctcaataaatggcaataacgatatcgtctttgtgtttttcacactcctgcctgggtaccttacattctcaaaagttggagattaacttctctaatcagttattctttcattgtgtttaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggtgagatgaactcataagtgttgtcagccattctggaaggtagctagggatttatagccaactcttgagggggagaaaaggaaaacttaattgtgtaactggagtagttataaggcctggtcagtcactgacaggaaggtcatttatattctctgaacctcttaattcttcacctgtaaaatggagtttttaataatgtataaacatagcagctgctaggataaacaaatacaccagggccagacttggaaaactttgtgacttcttaattttgtaggctgaatcttctccatttgttgagcgacttctgaaaaagggctatgaagttatttacctcacagaacctgtggatgaatactgtattcaggcccttcccgaatttgatgggaagaggttccagaatgttgccaaggaagga

SEQ ID NO: 8649 - DNA, 1173 bp, Homo sapiens
tggaaaagtacagtcgtccttaggtgtatgagggagattggttctaggacccctgccaaaatccacaaatattctagtcccccagtctgccctgtggaacccgtgtatatgaagagtgggagctctgtgtgtgtggattccacatcccaagaatacggtattttctatctgagtttggttgctgaacctgcacatacggagggcggactgtatttattggaaaaaaaatagcatataagttcaaacctgtggtgttcaagtgtcaatagtacattttgattttttttttttaccaagagttgttctgtgtaattatgaaagaataagggaaacgtatgaaccctaaaattggatatgttttgttaatgttcatttttatctcttaacagttactatgcgagtcagaagaaaacatttgaaattaatcccagacacccgctgatcagagacatgcttcgacgaattaaggtagtattaaagcagtcctcttgcttgtcttttaatttgagtactttgtatcttttaatattaatctagtgcatcttcttgcatttcaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtttgtatccccaaccttcccgcaaaggctggctggctttctttgtttctgttctttcagaataggcctctcatgattgagggatgtagctttgcgacatttgcctaatttctaccttttgaaagaattttattgaatgtttgaatccctgtagtgtcaggcactgcactagaaactaagtcctccttttacgtcctctttcctttttgcctgcctccttttgttagcttggctgttcattctagttaagaggatttagtctgtggttctgaataaacagaagtgacattaattatgattttatacatataaatgagcaaagtggaaataaatccaaggcattaatgggcccataaatgttgtgtttaggtggaagaagagcccgaagaagaacctgaagagacagcagaagacacaacagaagacacagagcaagacgaagatgaagaaatggatgtgg

SEQ ID NO: 8650 - DNA, 1252 bp, Homo sapiens
caactgatggctgaagctcctaatatggcagttgtgaatgaacagcaaatgccagaagaagttccagccccagctcctgctcaggaaccagtgcaaggtagtttcaccatgagagcttagaaagttcaacatcggatcagccagcttatttgagaaagggtttcatggtgaattttagctctattttagtgttaaaaagtcaaatccactttttaagtacttagtatgtgctaagcactgataggttctggggaataaaagaacatgggtcctgcccaaaaatatctcataatctagtagagaaaagtaataagtaaatacacgttacagctcagcacagtttgtagtgaagaggggcatagaatgaatgccctgaaagcttatggggttggcttctaactcagactgatggctcagaggctgcttcccagagcagagaaataacaccagggctctgaaactccaacaatgtggaggcttcatcccgataaagatcagagtagggacatgtccaggctgagggagctatacaggctgggtacagacacacacaagcatggcatggccagaaacagagcaattctgtgtccttggagtctgggatataacaaggaaatggtgagaggtgaggctggatggggacagttgaaacttgttttttaatcccaaagaatttatattctatcatgaaggcaatagggagctgttgagagaatgtaagcaagggatgacttacttgactggtgctttacaaattagcctggaaatattagagaagatagattggttggtagacaacaagtcggaacttggaggcaggccgggcacagtggctcatacctgtaatccctgcactttggaaggctgaggcgggtagatcacctgaggtcaggagttcatgaccagcctggcgaacatggcaaaaccctgcctcacacaaattagccgggcatggtggcgcacacctgtgattccagctactggggaggctgaggcacgagaattgcttgaatcctggaggcggaggctgagaggctgcagtgagccaagattgcaccactgcactccagctgggcaatagtgcgagactctgtctcaaaaacaaaaacaaaaacaaaaacaaaaacaaaacttggagtcaaggagtggattagatggattagagacactgtttgaataatctaggggagcactgaggaggacctgaaggggtggagaaagaattaggaaacacttaggaggtagaattacc

SEQ ID NO: 8651 - DNA, 2109 bp, Homo sapiens
catatacctgataagaagttaatatccaaaatatataagaaactcatacaactcaatagcaaaaaaacaaataacttgatttaaaaataggcaaaggactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcattgtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaggagacggtgcgcaaagccatggaagctgtggctgcccagggcaaggccaagaagtgaaggccggcggggaagatactgtccccaggagcaccctccctgcccatcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtttgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaatagcaaaaaaaaaaaaaaaaaaaaaaaaataggcaaaggaccagaatagacatttctctaaagaaagcacacaaatggccaagaggtatatgaaaagatactaaacatcactaataatcagggatattcaaatccaaaccacaataggatatcacttcacatctgttagaatggctattatcaaaaagtcaaaagataacaagtgttggtgatgatgcagagaaaagggaacccttgtacattgctagtgggaatgtaatttggaacagccattatgg

SEQ ID NO: 8652 - DNA, 2125 bp, Homo sapiens
gtgttttctcaatgtagataacagtatatagtgttctcttaatagttaaaaataagcatatgttcatatttgcataggagatttctagaaagatacacaagaaatgggaattagacttgttattgtctttttattcactgaatttttataatatgcatatggtacttttaatctccttttctttaattctgctcaatttaaattttctaatcttagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgt

SEQ ID NO: 8653 - DNA, 1138 bp, Homo sapiens
gttcaagcaattctcctgcctcatcctcctgagtagcagcaattacaggcacctgccaccacgcccagctaattttttgtacttttagtagagatggggtttcgccatgttggccaggctggtcttgaactcctgacctcaggtcatccgcccgcctcggcctcccaaagtgctgggattacaggcatgagtcaccctgccaggcactcttttacatctaaattagatttgtttctgtaaatagttgtcaaggcttctctcacttgtatttgagcttttattctgactctgaggtgtggacttttgatagcacacattgtgttaatgttataacatatatttaagagattaaatagtcataaagtgaagatgtgttcttctgaataggctttcatttttgtaggttgttaggaaggtgatggttatagtttctgtaatttacctatgattttctcttcagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggtaaataaaatatctcccattgtgcttttttttttcttctttttttttttgaggtggagtatcgctctgttgcccaggctggagtacagtggcaagatctcggctcactgcaacctctgcctcctgggttcaagcaactctcctgcctcagcctcctgagtagctgggattacaggcgtgcaccaccatgcctggctaagttttgtatttttagtagagacgggggttacaccatgttggccaggctggtctcaaactcctgacctcaggtgatccacctgcctcggcctcccaaagtgctgggattacaggtgtgagccaccatgcccggcccccattgtgcttttaagaaaataagagacattatttattttaactttgtaaatgtattacttgttttaaaaattcattttgtagtaaattatgtaacatttctcagaagtatttaattgcttatatcagcagtcctcaacatttttg

SEQ ID NO: 8654 - DNA, 1492 bp, Homo sapiens
gctgtatttagaattattttcttaggatagattactggaatggatttatgggtcagagtatgaacaattctaaggttctagagccctttaaatggtgtgtactaattaataacttcataagctcaaagagttccctgtacttagtagtaagaaataataataggttttgggccaggtgcagtggctcctgcctgtaattccagtgttttgggaggctgaggcaggcagatcatgaggtcaagagatcaatactagcctggccaacatggtgaaaccccgtctctactaaaaatacaaaaattagctgggcgtggtggcatgcgcctgtagtcccaactacttgggaggctgaggcaggagaatcgcttgaacccgggaggtggaggttgcagtgagctgagatcacaccactgcactccagcctggtgacagagtgagactccgtcttaaaaaaaaaaaaaaaaaaacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcaggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtggaaaaaaaaaaaaaaaaaaagtgatctggctggacaaactgagccagtcccacacaaaatcttaaaaaaaaaaaaagaaaagaaataataataggtttttaaaaatcattatttgcctattggagaggtaaaaacagatttctttatcttaatttgtatcactttgattattaatgaggcacaatattttttcctgtatgttgtatttcctatgtgtaccttgctgggctcaggtggtcctcccaccttagccttccaagtagctgggactatctaaattgtagtcactgtgttgtatttcattatctgaattgcctgttcattttcctcatgggataataatactaggaagagccccggtgcggtggcttacgcctgtaatcccagtactttgggaggcta

SEQ ID NO: 8655 - DNA, 2588 bp, Homo sapiens
ttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaatgatggtcttgggagtctttgcaagagtattgagtagatctctgatattgtgttgaaaagctagctgctgagtaggctccaatgatgctatgctgatttaagtatagaagaactaatcagttcattgccatttcccatcttctggcagtatcaggcacatagatggtcaataaatgtttccagaaatgttgattaccatgttcagattatgcattcacatgcacttaatcttcttaggtatcactttttaagcagaaactcctcttttatgtaatctttaccaaaaaccttcccagtttgtacttgtttttgtggtaagtagttgcagggtgctagtaataacaacagctaaatgagtgtttactgcaacacgtgcaggcactgtgcttgacacaccctggctgatgtgatccttacaacaatcctattagagaaggtgcttttgt

SEQ ID NO: 8656 - DNA, 1104 bp, Homo sapiens
atactcagtgctctgggaagtcctgccattaagaaccccagttaacccagaatttcttaaacttacacaaccacagaatcttttttggggactggagaggtaccacttcatttattcattaaatagttactgagcacctaccctgtgcagatgctattcacacctgagatatggaggtgacaaggcagacctggcaaacttacaatgttctcatctataaaatgggtatacaggagtgtctaccttgcagggttatggtgaggtctacatttaatgaactaatgcagggtaagtgtttggcacagcccagggacattgtaagtggtcagtgatacatatgtatgattgttatcaccctagtggaggatcagatattaaacaattaaacaggtacctatttagtaacaatggcgttaagttatacaaaagagaaggacagggtgtcaagagagcacatagcaaggaaacctaatgaatgttggcaggtgggatggcggtagtggtcacagaaggctctctcctgagcaagccatgctgaagctaagacatgaaggatgtggggattgttggaaaagagtgggaagggagtgaggcctccttgccttgggaatcatggcccgaatgtcaggggcttacacacacgggtgccgtctggggagttaaattctctggactgtctatttcagaattagggaggtaggggcaggctctagtaggctgtggggtccagaaatgaatgtctttaaaacttaccccagaaatttggagcacccttgggaatattttttggaattgctgctccaggacagcgggcctcagaggttcatgtgcttagaaatcacctgagtctcactcaaaatgcagccgtggggcctgggaatctatttaacagacacatcctgaggcgattctgctgcaggaggttccccgaccttgctttgagaaacacatctctggaagattgactcttataaaaaatcgggaacacgaaggcacgacagcaaatgattccagcagagaatatacaggggcacctctagagactttgtatttgatcttagaaagtacacagtgggcaagaagagtggtatgcaaccccatgtc

SEQ ID NO: 8657 - DNA, 1189 bp, Homo sapiens
aaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggc

SEQ ID NO: 8658 - DNA, 1179 bp, Homo sapiens
accaggtactatattatgttctgaggagtatagagaatttaatgatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatcccagagtttggca

SEQ ID NO: 8659 - DNA, 1201 bp, Homo sapiens
atatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaatttccttcccctggatgtttatgttcaaaattgaatgtcgtaaaccagtagttcttaatattaacctttttggggtcccccttaattgaatgaaatgaaatctgtggaatcatttttttataaaatgcatgcacataggtaaaaatttgaagtttaaaattggctcctgtcaatgtattccaggtgaaagaaaggtgttttctttcctttatacatccttgatctttccagagcttttttccaataaaaagaaccaatatgaagttactttaaatcctaatcctggaaagggattatcagtatgcattgtttaatgttagtaataactatagtgctatttgcaaacctgagtt

SEQ ID NO: 8660 - DNA, 1294 bp, Homo sapiens
aattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttctttcgttagatgtggttattttctagaacatccctggaagaaaactaaagtcagctctatagctttaacattcaatttcccaaaaactagggcataatgaaatcacagaagaggggatatagtatcaaaaaatacttccagtcaacatgagtagaatatgtgat

SEQ ID NO: 8661 - DNA, 1483 bp, Homo sapiens
ccctctaccccccatgtttttcctcttctgtgtcttctctttttatacaggcacttggcattggatttagtgacaatccaggatgatctcatttcaggatccttcattacatctgcaaagactctttttttcaaatattcacatgttctgggtggtcatatcttttaggggagggtcacagttcaacccactacaaagggtttatttttatatttttttctcattttttaattttgtagggatggcctcttgctttgttgcccaggctggcctcaaactgtggcctcaaaggatcctcctgtctaagcctcccaaagtgctggggttacagacatgggccaccatgcctagcttactacaaagggtttaatacaactgttcttatagctatattttacagtacatttggaatatttgtaaaaaacgaaaccaggtattataggaaaagtgcataaattctaattgtaaaaaacataagagctcagatgctactagtgctggacagaactctgcaaaattaggtagatataaatagttccatctttttttgttgtttataagacggagtctcgctctgtttcccaggctggagtgcagtggcgcaatctcggctcactgcaagctccacctcccgggttcacaccattctcctggctcagcctcccgagtagctgggactacgcccggctaattttttgtatttttagtagggtttcaccctactaaaaatcttggccaggatggtctcggtcttctgaccttgtgatccgcccacctcggcatcccaaagtgctgagattacaggcatgagccaccgcgcctggccaaatagttccatcttttaaggagtttgaatactcaaaaaatcatgataaagaataaacataaaggagtgtgcagatgccatttaactgaccagttattgatctgcagtagatactgtcttcagtttacaaaatgagaaactaacattcatataaaactgtactgattgcattttcgtttattcaacaaaccagttcaacaagccattatttattcaacaaacatttattgatgacctcctatttagcagacgctgttctaggcacgggggatgtaaaagtgaacacgtcatatgatttttattgggctttgtcctctaccctactaaacagtaggaaaaagacaaactcattctctttctatactttcagcactcagcacactttggtcaccaaaatgtgtgggttttccccacatcaagcaattctgtgacactaactggctgtcctacaatttaactcaattctgacatatctacctggagatagcctcagatcccacaagttaagggcatgatcccgccagactaccccctcccccacacttcagatgccaattgcaagtctaggcctctggtacttctgacaaacgagctataaactaggggttcctgcaacatccccctgggatttgattattttctagaatggcccacaaa

SEQ ID NO: 8662 - DNA, 1238 bp, Homo sapiens
aggggaagcagtagcactaatgctatgtagttgtcatctttgatctggctaggccctgggaatcgggtttagtcatcctgtgggatctatgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctc

SEQ ID NO: 8663 - DNA, 2171 bp, Homo sapiens
cgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttttccagagtggttacattctgagaatttcgtaattatgatgtgttttattagcacatggtataaacgattagcaaataggtaagtttactattttaaggctgttttttcttttaattctgaaaccgagatggcctcactcttgggccggggacctcctttgatggactgttagcaagtgtgttcaatgattacttgtctccagctctgttagcttcaagcacaggatctcaaccctcactacctattagaatcttcctaggagcttttaaaaaatgcctgggccctgcccgcacagatgctgattgaataggcataaagaggctggcactgtttttttttttttttt

SEQ ID NO: 8664 - DNA, 1197 bp, Homo sapiens
ttatttggtttgtactggtcccagattattatcaaatacagagaagttttgggatttgggggagggtgaggtggagtggattgttgagtagcacaaatccatatttccttatagctttgggttactggtggttctaatgcccatcttggtttcattttaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtaaaagccttttaaaagaaaaaattttaatactttttgacatcatatgttattcaataatatttctgaatatttggcaaaaagggcagaaaaaagtaacaacctataaaaccaccatccaaactcaaccaatgaggtcatttttgatgaatttccttccagtctgtttttctatacactatgtttttacctatcagtaatctatgctaactataattttctagttataattttgaataatagaaaagccactttaaggaaatatttagagtagtttatgtccctgcatctgcactggtatttcttcatttacacatttagcttacagactactttagaattttatccccctgcaaaggtatgactccattataattacaaacttgtaatgcattttgttgatgaaacaaatagcccttgcccttatgggtctcacaggctagtgcaggagactgacattgatcagaggatcatgcataaatccaggttaaggaatcatataggtaactatgaggccattttatagcaagagaatttgaccttgttgggaagatcagcatggctttcccgaggaagtgagctggaatctgaaggatagggaagagttaactaaagaagaggatcagggagcatgttctaagtaatgagaaaagcttgtgcaagggtcccagagcttggtagttgaaaggtctgaaagaagaccagcgtggctaacaagaagagagtgcagggaagcatggtgcacatgagttggtgggtgacgcaaggggtaggggccagagtaagcaagtccttgcaaccatgttagtattgtctttattttattttattaattttatttttgagacagggtctcagtctgtcactgaggctggagt

SEQ ID NO: 8665 - DNA, 1207 bp, Homo sapiens
ttttcaaggatccaggggagtgttaacacattgaagcgcaccgcatatcatttacattttaaaccagtgttaagggaaaatgaccataacttttaagacttctaaatattggaatggactttatgcctctgtccctggagaaaacagttttaatctttcatttgaaaataagaaaagaaaccttcccgctgtgattaaggatttgaataattctgaaacagagaaatactgttagaaaaagataagtctggttctaagattgagaactctctttctacccctaatgaattcagtaaaatacaaacttttaaaaatcatctgtctaatttgagattcgagatcatcaaattctgtctaaatattttgttttaacttctaagctcattatggtctctttgtgttaacttgtattaaaatctgtcagctatgactggtctcataagcacagtcagcggaccagaataagttaattatttacttgtgtcactagtgctcttcatctaatgaaatgcacagctgtgttagatctgcagttggatgtgtagcttccattgttccgcaagtcagcagagggtagaagccgcaatgatggagagccctcagttctttctgctgttctggctttctgtgtcgatttcatggatcttttatcattcactttcacacaaaacaaacaacacagggctgtctgctatgggaaccatcttggcatataaaagggttttcagggcctgaagtaattttaagtcagctaagatttaatttttgacttacaggtgcccttggttcagatattgccaaagcagttcctataatggaaggaaaaaaatccgaaagctgcttatgtgtattttttttaactaaatgtcagaagagggctgataagaaaacaacttccccagaaggaagctctgcactaaatattcttaatcagatttcaagcaaaggtattagagattcacatttcagtggaacgagcacttttttcattttaataacataataaagttgaatttgcttaattaaatgtgtcgattaaaactgaaaacacaaaatgtaagtcatctctctccttacccacccccaatataagtatgtcatgcttccttggtcagtttctgcacctcctgcccctctctcccaccttctcttgatggagggtggacaggcagcttcctcctgagcagacgccagcctcctcctgcga

SEQ ID NO: 8666 - DNA, 1130 bp, Homo sapiens
gtctttttgcaagagcctgtactctggacaaatatgaaccaattcttgagacgttaatctttatttctgggaagggaacagctatgattcaaactgattgtcttccatcctgatggtgaccttatatttcagtttctaacattccgtgatttaaaaaataataaaaaccttttctctctggatttttaactgttgttaagtacattggcagagaaacattctgtgttaagtcatttgagccaaataatgatttttgcatactcgttcttgtttttcagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagaggtaaggtagagaaggctatttttgtctacctggaatttaattggtctgggacatccctagagtttcctgcaagagaagaatacaagttgggaaatggaaaaagttcccacttctcccattaagcaattgtattacccaggatatacttcttaaccattgtaagtcttattctttccatttgtgtgataacacctatcagaataggtgtaaaaatggactactattttgtaagatgccaaatat

SEQ ID NO: 8667 - DNA, 2215 bp, Homo sapiens
aaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagggtgatcttaccatttttagttactttgcagttcagaaagtgctgtagccagtttaaaattttttttatagtaatgtacaaacatatctttggatatgtattttgatgctgacacaaccatgaaatacaaatatattttaagcaactctaataataaagattaagagtgtagatttctaggttttaccccaacttgccaaatctctgcaaggtggggcccaggactgcattttaacaacctctctgggtaattcttgagtacaacaagagtactttcaaacaaagtttgaaaactgatggattataaagcagggagcacttctgtctgttccaagtagctgtggaaccaactgagacatctcactggaaagaaatgactgactaaaaggggtggggaggagtgtagaaaattgatatttactgggcatctgcttacctgccaggtactggccatacttctcatttaatcagcatgagggccttatgaaggaagtatcattactctcttacaaatacagaac

SEQ ID NO: 8668 - DNA, 1200 bp, Homo sapiens
tctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcc

SEQ ID NO: 8669 - DNA, 1158 bp, Homo sapiens
atttttagtagagatggagtttcaccatgttgaccgggctggtcttgatccaccctccggtgattcaccctcctcgccttcccaatgtgttgggattacaggcatgaaccactgctcggcctccaccgtctattttaaggaggcctcctaggattctgaaacccactaaaatgtgggagccatctctctgcagcatccaggccaggcctgactacccccgaagagtctgctgtcccatcttatgttctggcaggttgcgggcagcagcaggtgtggcatgggacagaaggggtgtcagagttgacctgacctcctgatcctaagaaatgctgtcatctcagcatctggaagttgacattcatactaataaaaaaagtcagacgtggtgcctgtgctcaaattgagggctgggcaactgtgaggacaaaaggtaggaggcatggaagtggggctgatgcccaagagatgggatcattgactgtcagggtggagagacccttaggacatctggtccaggcgtcttatttcacagatgagaagactgaggcctagaagggagaaatgactgctaattagatacagatgagattgctgtgcatcctctgggcttctaggcacctgctccctttccagtcttgcctccaggctcagggctctgggtactccaagaacactgctgctgggtaaattcaggggatcctggtggtgtgctggctccaaagggagcagaaaccggatagcagagattacagctgcctctgacatgatgtcatattaaaatgaaaggtttagggagatgagcactgcagcctgtcaccaggcagcccgagtgttatttaggactttgtttttgtcttggtggactgcactcagtgcagccgtgagtcaccaaatgatagctctcaggttttgaccgcatcccatgtgctgggtgctgtgcagacctcatttctaaactttgtctgtaaaattcccattttacagacaaaaaagccaagcctcagggactttaagtaacttgcccaagactggggtttgatcctccctcagtctgaaccaaagctggggacctttccacttgcctctgctcctttcatcgtcagctgccagcctatggtttgggcaccagtttgacaccagggttattgccaattttat

SEQ ID NO: 8670 - DNA, 1379 bp, Homo sapiens
gtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggattcctctggtagtctcatttcatggaggaaggagatgagtgagtcttctagggaaagtcaagtacaatttgaatctttctgaggttagaagaagagagcatttctagagtattttagcttttgagatcatattcttattgtttctgctgttagtacttaagacaaactgcttcctgtgcttccaaccctcttctgccctgttcctgcctaaggtatgcctttactctgttacctccttggagaaatgtggcaggtctgcagtggagggttgggggatgtgttgcggatggttagggttggctgctgacactgggtcgtgacgcctccctcagggcagctctggttcctagggcagcttcaaactcagcattttgccaaaggcatccagctggctggttcccccatacccaggaaaccactggtactgggactctaagctccctttcttcctttatctcagtagcacacactgggttcacttccttcattcccaagactgaaatgatgcccaagatagttacgcc

SEQ ID NO: 8671 - DNA, 1146 bp, Homo sapiens
ccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaccatgtggtagagtgttgtgtaagacaggttcacaaatgggatgttttcctagtgtgtgtgtgtgtgtgtgtgtgtgtgtatgagagagagagagagagacaacagagacagagagaggcagagaggcatagagagacagagagagagacaagaaacagagatagacagaaaatgttcggggtggcaggcgggttggtgtataactgctttgtgcctgtgtgactctggcatagctgctcagggagaattacgtgcctctgtgtgtaaaattgcctttgtgttctcctgcctttctatgttttgaaactgtatcccacaagttgccggtatgaccatcttatttgtaatgagtctgtgcaggt

SEQ ID NO: 8672 - DNA, 1703 bp, Homo sapiens
ttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaa

SEQ ID NO: 8673 - DNA, 1238 bp, Homo sapiens
tgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccattca

SEQ ID NO: 8674 - DNA, 1213 bp, Homo sapiens
gatttatgttattacttccacttgattgagcccacttacccgagtgtaattggggcacagaaagtcgtgggacaggtcaggcggatcacaaaagacttctcggggtggtgcttgcccctccgagtctggtgagggagtaagtgtcacatgcagctgtcacagcactttcacttcacacctctgttcaagctccctgaagagaagtaacagttaaccatggctacttttcttttgaaaacctgtagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtaggtttatggaaaaaaagaatgcctttcatctgtggttgctttagacaggcactttcttcctgcagcagtgatatttaggatagacatggaagttttacgctctgtttggatctaaacttccttgtgagccaaggtccatcctgagccggttgactgaggtctgactcatggcatggctccttcttgctgggtgcttagcaatgacaagggactgtgctgaatgctttatgtgtgtcagctcattgactcctcatgagactctgtgaatggttacttttattcttgccgttttacagaggaagacatggaggcctggagaggttaagtgactcgctccggtggccccattaacaagtttcagagcatggcttggctctagtctgcctggctgggctgctcatggggacaaggctggtgtcagaggagtcaggtgagctgggtcatgcctcgaatcatggtttttctctgtcttccttcttcctataggtgttcaggtacagcacttcccta

SEQ ID NO: 8675 - DNA, 1251 bp, Homo sapiens
gcaaagtgaacaacgaaatcagaacagtgatccaggtggctgatcgcaagccctctaaaggcagagataataaagagctagaacttctttttcatccctttgtctcccaagtgtctttccctggtagctgcagaggtcaaaggtcccaaacacagtgaagagctggactttctaaaatccagttgctgtcaaaacctctcagaaaagccaaccagcaaggcactcatctttgctgccccaagggaccaggttcagggagctgagtcacagaggagcatgcttggaagctggccagctccacagcagagcagtttgccaggccacgtgccacctgcttcctgtggctcacggccttctggctggcaagcccctgtgggccaggaagctcagacctaacctgctgtggcaggaggtagctctgaagtgatttgtcaggaactgtcctcaggtgaagggagaaatgagacaaggcacttttgctcccagaacctggcccttaggggactgtgaattgtgatcagaaaatgggagagaggacatttctttaaccttgagatctcccatctgagtttcaggagcagaacctgaatcaaccaagaagggttagcagaattgggaaactgaatgatagacatagtcaaagagtctggctgttgggaaatctggttttctgtaaggcagtggggcactgttctacatgggcaaggatctgcctgcctcacattatcccccagggctgtcaaccagaccccaggcatcctctttagttgatctggaggagatgctcctataggcaaaggggacaccaaagagagcattcggcctgactcggctgtgccactgccactgtgctacttacctgaaatcttcccaacctctctgatgccattcggcacttctagtcaaaaggatttaggctaacatttggtatgaggacatcggagaagctgatattcacaaaaccagcataggaaatcactaccttttaaggaagagattcctgttacaggccacaagcagatccctaagagacttctcacaggttccactcctgacttagagaagtgtctgggctgtctttgcttacccaagccaggcagtgcagctgtgtatacttcatgcttgagaatcccagctgcagctttgataaagtgggagtcctgagaagacccttagccgtttgagttattaaacagaaatcatccccaccaaccctgagagcctctttggcctcccttttttattggctgg

SEQ ID NO: 8676 - DNA, 2611 bp, Homo sapiens
aaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaatggtgtttgtgtttatttcacgccttggctgtctgtgaggcagcccccacctctctgcctgacatagcttctctgactttggtggacgagcacggtgccatactcctctccgggggtaagtacaggggaagcgcgtgtgggtggctcagttcaagtacaagtgaggtctccaagccagtcaagcactgtgttttggcttccagcagacctgagcctttggatcctgcctcagacctttgccagcggtgtgtcctgggatggggttcctaatccttctgagtcccttttcttgaaaggaggatgataattccatgtagttcagatgagaggaatacctgtgtggccacacaaacaaccctcgctgcatggccgctactgttactattatgagttgattttctga

SEQ ID NO: 8677 - DNA, 1203 bp, Homo sapiens
catctcctaaccgaagaagggagatgggtgcctttggggaacaaatttgatacgtgttttcaaatgtaccttcttattggcgaagatgaatcttttcattaagttgaaaatttattttttatttagatacttttatttctgttcaaaaaattgtcgttcagtggcagataagtacactacactgttataagtgttcttcatctggttttggagtggggatttgaactcaaggccagttgcatttggtctccacattgttttagcttattccttcaccaagagcaaggggcatttggaaacttgacattttactggtaggctttatggcagccaactgagaagacagccatagcttgttagctaaggtcagacactggagcaccatgatttgttttggagttacgagtttttatttccccttttatagactgagggataaatgtaagactttttttttccttcaaagaaatggaacaagccaattaagaagcacaaaatagacataatgaatggctaatcttcctctgaattcagacatttcctttcaactttcacatccacaaaggttctgtgagttcatctttgcttttacagaccatgagaaactgagtttcacttatcccatttgagggagacctgtgtgcagtgccccagctaactgatcttatgatttggtttttccttgcattcagtgacctacacttaatgaatgtgtccttgtatttcattctttaaccagcattatgggaactaggatagaataagttgctttacaaattgtcatgtttagatgaggtgttgctttttagaggagcatcgagggtctttcccaggctataatactgtctgtctagctttgctccttaaatatgagtttgttttagaggaggtgacattggtataagctaagccctgtgacagccattggaaataagatcaatacttgggtttctatagtcgataggttcatgagtactatgtgagatttttgtgtattaaagtgtgtgtatttagctcttagcgtcaatgtggcatagagggaagatcacaaatctgggaattgatgagctgtggagttcagtcctggctcagtcactgacttgtagtgggacgtggatgtgtctctttatccttccgctcctctgtttctctctctgtaacataagcagctgtgtataaaagttattttctggccgggcacag

SEQ ID NO: 8678 - DNA, 1223 bp, Homo sapiens
tctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggt

SEQ ID NO: 8679 - DNA, 1114 bp, Homo sapiens
atcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactggga

SEQ ID NO: 8680 - DNA, 1201 bp, Homo sapiens
gcactccagtctgggcaacaagaatgaaactcatctcaaaaaaacaaaaaaaacaaaaaacaaaaaaaagaatacttgagatcaggtaatttataaagaagagatttatttgactcacgattctgcaggctgtacaagcatggcaccagcatctgcttggcttctggtgaggcctcaggaagcttttactcatggaggaaggcaaaggaggggcaggcgtgtcacaaggagagagagggacaaagggggagaggagggaatcaccagatcctttttagcaagcagatatcacgagagggcctgatgttactaatactatttgatggttggcgatgtctgtgcttcagaagggatgctttcaccgacccgtgtctccttcccctaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagacaccacccagagtcacccggccaaaccctcagtgaacaaccaaaatatctctctgtagataccgtccaggctcaggcccatgtgacacctgctgtccacccaccggacctgttcagtaggtttctcccacactcacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctct

SEQ ID NO: 8681 - DNA, 1111 bp, Homo sapiens
cttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtttgttttgtgcaagtgtcctttgtgcgtccaggccagggcatccatggacgtccttgggctgccctttcccttggcgcctcccagggttcccatagcaaccaccgtctgcaggaggggccgcccttgcccctcctccccgccctgccgctcagtggaacggcccaaccctcccctggctgcggtgagcgctgggcccaacccccggcctggagcagcgccccaactccgagcaccgtggagcaccggctgccagctgagaccccagaggggtaactaacggcctgaggaaggcatttcttcggggaacatggcgtgcccgtcgtggctacgttctgccaagccctgtgacgttggaggggagccgcctgc

SEQ ID NO: 8682 - DNA, 1244 bp, Homo sapiens
tttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgcttctgttttctggctcttttcaggcatgcccggcataaccaggcccctaaaatcggtttacaacaaaggcagggcccccacgttctgcctcagccccttaaagtcgctccaggtggaagggaaaagacagtcatgtttctgtagtgtttgtttgaattcaaacaccaaaaggaagtcttggggtcaaaggctgcctggctcatgaaaaagtgaatcagctggtgttaccactgatttgctattatggggcagagggcttcagttcaccaaacccaatcccttgacacatgtgagttccatttatttaaagcaaaattcaaatttcacagctttaggaaatttcctttacttagtctcagaccatgcacagtaagtcatcgataggttcttggaagctgagacttgaagcaaaaccatgaggctaatggatgtaaacaagagttaaattcctacagcatgttgctgggcacaaaaacatcacccaatttctaaataaagacc

SEQ ID NO: 8683 - DNA, 1650 bp, Homo sapiens
cttgatacagaatgatctctaggttaagttaggcacaagaggaagacatgtacaactctgtgtggtgggccaccttgtgtgttttttgaagtgtgtgaataaatatgtgtattacacatatttacatgcacagaatctttgagagggtaaaatgatgagaaactgtacctttaagaagggaaactaggggcagggagacctgtttctctgcatccccttgattttctgtgcatttagcaccacatgtaagtgttgccattgaaaatatcagtttatttaaaaataatactggtggccttcagcagaatcccaggggcctgatttagcctggcggccctgcttaaagtccaggtgttggcagagggggtgggccataacttacctgccctgtatactgtgggaacacaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccct

SEQ ID NO: 8684 - DNA, 1178 bp, Homo sapiens
gggctcaggtgactgcacctgtgcagtcccctctgcatgaataaggagccggcaggatgccaagtgcaaggccagtgagtgcgggtctcccgggctccctctgttcgcaccacgtgcagtgggtgccaccagcctccgcctcgccctcaccgtctcccattttctcctcacatggtctctctgtgggagggtgtcagctgctgctctgttcctcttaacaatcccacaggagacctgcctctcggggacgcctcaccagtgccctggctgggcatttgtgctgttcctactctgcagtcacacgtgctctcacaagtggccagtcgcacctattgggtatgggtttcatgtgtcttagtccccgagagcagcacccttgagagagatgtacggcgtgtgccagttttggggccagatccaccccgccactccatacggctggctagacagcagttacaacacggtaacagacagagcaaacacgtgctacacagctgcaagggcccgtcctggaagagcaggagcctgccccgtccccactgaccctgctttgtgttgcagttcgtgaccagctgctccagacccccgctcctgggattcgcctacctcaagcctccattctccatccgctgcgtggaggtgtcggacgatcaggtacccccacggggtgggtggggaagagccttgacttccctcttggtggttgtctgctgtgcccactgtgcaaggcccttatctagtccatatctcagcaaggcaggcagctggacccctcagagccaagtgaggagggccccacagttctcacggcaggagaaccagccagccccagagagactgcccacggactcagccctctctcggcagcccctttctctttccttcctcagggaagggtacctggagtgggggtgggtacgtgctgtttttagtggcgtctggcctcaccagggctccagatctgaggcagcatgggagaaagtgagagagtgggctcaggaggcaggcaggcgcagactcgaatgctactcctaccccagcaggctgtgcacgtccaggctcgctgcttcatttcctcattggccaaaggagaaggaaagccttcagggttacggagctctgtgtgtctcaagcctggcccactgtgggtgctcaaatgagagtcctactccccataa

SEQ ID NO: 8685 - DNA, 1670 bp, Homo sapiens
tccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcatatgatggctgcgttctgcatttcattccgccatatgcctggaccgttcacacttgggtatctgggcttagggagcatgtaggcttccacaatggagggaagatgtggaggggcgcagagcacatgtcctcatctccccagccagagttcagggatgttggcagtctgtcctatttgcttccaattgtgtttcaagaagtaacacatttcagatgagcaccctctatgggcccatccctctcacccacttcccagaggcagctgtcaccataggttgggtgtatatctttgcagtccatgttttacacagtaatattctttttttgtttttttgagatggggttttgccatgtcacccagaccagtcgcgaactcaggggctcaagtgatccgcccaccttggcttcccaaagtgctaagattactggcatgagccaccatgcccagccagtagtaactttcaaaagtgatcaacggatgttgaacaaacccagataagtgtctggagtgaaattttacagctact

SEQ ID NO: 8686 - DNA, 1177 bp, Homo sapiens
aactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcacatctgtgcactgtattggttcttgatttttttttctttcctgcatcagaaattacaactggggacccttacaaatcctaccaagaatgtattttctggcgtccatggttttaaaattttatttatctattatttttaaatgtttttgtagagattggggtcttgctatgttgcccaggctggtctcaatctcctggcctcaagcaatcctcttgcctcagcctcccaaagggttgggattacaggcatgagccactgcaccaggcctggcctccgtggtcttaaaaaacagaactggttgctgcatggagaaacgggaatttcacataagaatcttgggtttcggcagggtgcagtggctcacttctgtaatcccagcattttgggaggccgaggtgggtggatcacttgatgtcaggagttc

SEQ ID NO: 8687 - DNA, 1272 bp, Homo sapiens
tcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaatgctgtgctccccatcaattagttgatgtttccagatactctgtaaaaggtctgaggaagttctcccaaaacgccatcattagtgagatgcagtgtttcatatgctttggggctctgcagttttacagtaatgactatctttttcttcctctgtgctt

SEQ ID NO: 8688 - DNA, 1088 bp, Homo sapiens
gaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgt

SEQ ID NO: 8689 - DNA, 1170 bp, Homo sapiens
aacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagat

SEQ ID NO: 8690 - DNA, 1058 bp, Homo sapiens
catttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagag

SEQ ID NO: 8691 - DNA, 1250 bp, Homo sapiens
ttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcg

SEQ ID NO: 8692 - DNA, 1135 bp, Homo sapiens
ttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatt

SEQ ID NO: 8693 - DNA, 1672 bp, Homo sapiens
agtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatc

SEQ ID NO: 8694 - DNA, 1275 bp, Homo sapiens
tagggagtcagaaggagcccagcgaagtgccaacacctaagagacctcggggccaaccaaagggaagcaaaaacaagggtgccgccaagacccggaaaaccaccataactccaggaaggaaaccaaggggcagacccaaaaaactggagaagtaggaagaggagggcatctcgcaagagtcctcggaggaggagcagtgaaccgtgcgtgccgcctgctcctcactggaggagcagctgccttctgggactggacagctttgctccgctcccaccgccctcgccccttccgcaggcccaccatcaccaccgcctctggccgccacccccatcttccacctgtgcccacaccaccacactacgcagcacaccagccactgcagggctcccatgggctgagtggggagcagttttcccctggcctcagttcccagctccccccgcccacccacgcatacacacatgccctcctggacaaggctagcatctcacttagccgcaccctgcacctgctgcgtccccactccgttggtggtggggacattgctctctgggcttttggtttgggggcgccctctctgcttcactgttccctctggcctcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacacttttcatccttccccaccttccctagtccctgcactaggttggacagcccccttcggctacaggaaggcaggaggggtgagtcccctactccctcttcactgtggccgcagcccccttgccctccgcctgggatcgagtacatattgtggtgatggagatgcagtcacttattgtccaggtgaggcccacgagccctgtgtccgccgcctgaggtgggctggggctgctcccctaaccctactttgcttccgccactcagccatttccccctcctcagatggggcaccaatagcaaggagctcaccctgcccgctcccaaccccgctcctgctcttccctgcccctcaaggttctggttccatttttcctctgtccacaaactacctctgaacagttgtgttgttttttgttcaatgttccattcttccacatccgtcattgctgctgctaccagcgccaaatattcatcctcactgcctcctgttctgcccacgatcc

SEQ ID NO: 8695 - DNA, 1105 bp, Homo sapiens
tctcggctcactgcagccttcgcctcctgggttcaagtgattctccagcttagcctcccacatggctgggactacaggcgcacgccgccacgcctggctaattttttatattttagtagagatggggtttcactgtgttgcccaggctggttgcaaactcctgagctcaggcaatctgcctgcctcagcctcccaaagtgctgggattacaggcatgagccaccacgtccagccaacatcatttacttaattgtaagtttatataatttgatttttgagaagagctgtgtttaacaaccagcttgaaaaatgcctcaaaatttaacaattggttttcttgagccagaaagaaccagccctcgcacctcaatgctgctatcccttctccctcccctaattaatcttgggtggtttactctttttttcctttaagggaaggttgtttgccacagtgacatttgctctttttctgcttctgtgttcttcctgggcttgccattacaggcttaccactcttctctcatggatcctgataccaaactcatcggaaacatggcactgttgcctatcagaagtcaattcaaaggacctgcccccagagagagtaagtctaaacccattattttcaaattttggtacgaaatgcctaacaatcttctgaaatgatcaaatcagaaaaattcttagctcagtcttctctctcaaattgcccttgtactttgcttggtagatactgtggtctagacctttcaagatagtggttatatgttgcatttaataggaaattgtattatttcttctgacttctccaggaaactcttttgagaaaatggaggaaatgtgcttaattctggacactgtttatcagttctttcaaacaaatctaatgctgttacgtctagaatgccacatgcccatcctttctgtcatcaacctggaaaagaacaacaacaaatattttaacctcttcctcgtctaaatctacttcctttattcattcttcaagatcttcatttttagcaatacctcaatcttaaatctgaagtgtactatgtaacattacttacgtctattcccgcttttctgaattttatttcagaaagcc

SEQ ID NO: 8696 - DNA, 1144 bp, Homo sapiens
gactaacatactatccctcagaatgtccaacacagtcagttattcttctggtgctggaaaagaatgtttcttcagttgagactaagtagagtaattggattgattttaggtaccatgttatacctcaaaaatcattttgagaaggcaagatgcccacactgagaggcgcacagcaagtaacacttgacagaacagcagattcgctctttccttgttcatctagagcaatgggttctccgacttcaaagggcatctgaatcacccgagtggaatggcaagcagagccacttgcactgtttaattggccatttctttctcttttgtcaagttaacgtagttgaatttgctaaagtaaaatacagttggcacaactctcttgaacattcatctcttcagataaggaatattgccaacttctctaatacaatgcagactataaatcctcttattctgtcttttagcatccagacctcaccacaggccagaagcgttacctgtgcagcattgctaaaatctataatgcaaactatctgaagatgttaatgaagaggcagtacatgcacgtacttcagcacagctcacaaaagccaggcaggtgcacctccagttgtcttttcactagtttttacaattagtgagagggtcttttaacaggtgatttgtatcacaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggtctgtttcttagtgtaaaaggggggaaatgcatctcagtttaatttttttttttctcagacagggttttgttctctcacccaggctggagtgtagtggtgtgatacagtttactgtattctcaaactcctgggctcaagcaatgctcctgcctcagactcccaagtagctagggctaaaggcacaaaccaccatgccctgctagttaaaaaaaattgtttgtacagaaagcatctcactatgttggccaaggtactctcacctccgcctcccaaagcactgggattaca

SEQ ID NO: 8697 - DNA, 2757 bp, Homo sapiens
gggtatactgacaaaccaaaactgcctggaatgcaagcatttgtctcctagtacttaatttaagtacacattttttattgacttttccttttaaaatatactgataggttctcattttcattgtaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccactt

SEQ ID NO: 8698 - DNA, 1307 bp, Homo sapiens
tgtgagtagattttcccttgattgttttttatcctctcagaactttctctgacttggattttaaaagttattttggccaggcatagtggctcgcatctgtaattccagcactttggagaggccaagccaggaggattgcttgatgccatgaatatgagaacagcctataacatatcgagacccctgtcattagaaaaagttgtaaaagttagccaggtgtaatggtgcacacctgtagccgtagctatttgggaggctgaggcgggaggatcgcttgaacccaggggtttaaggctgcagtgagctatgatcgcaccactgcactccagcctaggcaacagagcaagaccctatctctgaaaatatatacatatatatgttataagctgttttgctttgctcagtggttgtgctttctataatgtaattaaaatagtaattgcaaagagaatttcttttcctgtatggtctgaaattaatcagccatcaaaaagcctgcataatgtcttttatctctgtgcttctgtacttaggttttggtagagttggatacatggtttttaactcttacaatatgcatcccatattgtaactcgatacaataagctcttgtagattttagccatcaaaaagcctgcataatgtcttttatctctgtgcttctgtacttaggttttggtagagttggatacatggtttttaactcttacaatatgcatcccatattgtaactcgatacaataagctcttgtagattttaatggtctgtgaacagtgcaggtttcctagagaactacctcacactgagcatccttatcttctcagctcagtcattataagccatcaatcataacatcgctcattattgtcatcaactgggggaagcccatagaagagttttttaaatcactggattttattttacagtgttctgtataatataattgtttccatgtactgtttaaacctactgcaccccatgcattactgcatgtaattctagtgtgtatccagttgtcctttttctgtgtttttttcttttaaccaaaagtaaataaaatataatcatagatttcagtttttatgtcaggattattgaatttctctgtagacaaatggaacttttgaaggggtagtatccttttaaaagttctgctttcttcattttttttttttcctcattgaataggtttatcaccagatcttcaatctatggagcagattcggcgaattatgcgaccaactgatgtaccagatcaaggtcttctttgtgatcttttgtggtctgaccccgataaagatgtctt

SEQ ID NO: 8699 - DNA, 8086 bp, Homo sapiens
gagtagctgggattacaggtgcacgccatgttggcgaggatggtctggatctcttgacctcatcatgatctgcccgcctcaccctcccaaagtgctgggattacaagcgtgagccattgcatctggcctgcagtcctgtttctaacagcattcgcacagacaggatggctccttttttggaatactataaaagaagtcttacttggtatcgaagatgcaattaagtcttgtctaagattttaagattctaattagacattaaaaccatgtttattataagtgtcctgaaaatgaagccactcagaaagctagttaaaccatgtttttgcccctttatctaaatctcgtattgtattttgtattttggcttcattggactaattgcgatttttctcttgcagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtaagtttggggcacacaggttatcttttgttacatgattgattaactgagtcaaggatatgttgatgaccttgtattagctagcagaatgattatcctgtttgcgaatagcttggaactacttaaaagtaagttaaatagtagctttagaataaatacctctaatggacttagtttacttagatgtacttcagatttttaaaaaaaatattttgctgaaggaataaacattgcaaaagaaaaaaatgaaactaagaatggagagctgaggaaaggtctgaactacatggatgtataggaatatgtttaagtttaaagcaacactggttatagctaaaaatagaacttccttgatactgattttgtggttctgttttctgcataatagaagcaaataatctgtgttttaactcaatgtaaaaccaaactttattcgtttgagtaatatattcttatagcatatttgcattgataaaactttgtgttcatgtttttaaaagtaaaatgttctttggcattatctagcagggagaaattgaaagctaaatgcattgatgggtggggggtgggggtggtgtgtatgtgtgtatgtgcttttgttcagatggggccaagactcactagaagtgcagcagttctgctgacacagtacccagagactgagctgtcagagatctgatattgatcagtcagcctgaaagggataccatgttacttggcaagaatgcatgcttggacataataaccctttccacagaataaattcttaatagttgaattttatgtgaggttctggacatacacatatacttaaaatttttgttaagctcagttgaactaaatatgatataagattggaaattacttagtgttggctgcccagttaaactctcattactagaggtcaatgccattgtacaatgaatatttaaagaatgtctttccaaagctttgttagtggattgagctttaagtatgggaacactgtgtaacaaaattcttgcttccaggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaagtacttttctatatctaaggaagagttattgaaattaagatatttatcataaacaattatcacatacttctgttaggaattgtgagagtttagatgcagtggtatcatctctcatgttttctatttcatcaacttgtttttagcttagcttttttaggggggtgggggaacggagtctcactctgttgcccaggctggagtgcagtagcaccatcttacctcattgcaacctctgcctcccaggctcaagcaatcctcctgcctcagcctcccaggtagctaggactgcagacatgcatcaccacgcttggctaatttgtgtatttttttgaagagatggggtttcaccttgttgcccaagctgatctgaaactcctggctcaaggaatctgcccgcctaggccactcaaagtactgggattactggcgtgagccatgatgcccagccagttttttctctcttgggtagaaaaataacactgccgctgtaataaaataaggtcttggattcttttatgatgtgatgatcagattaggaagtaatgatcatggtaatggttgctttaagatttaaattgttgtattcacagataacttaattcttagtagaaatctgagaaccattccaaatagtttttttaagcaactttattatgtaatttcattccataaaattattctgttaaaagtgtacaattcagcgatttgtagtaaatttatagagttatgcgaccatcaccatagtccccaggcaaccactaatctactttttgtcttttctagagaatattgcatgcaaatggaatcttgcaatacgtaaataattagtttttgaaattattatagtttttctccttctggcatatccacacccaggaagaatggcaataactttcctaaaactaaaatgtgctgaacaaagattatttttacagtattttacacattttgtgacccattttggattgtttaattaaaggtatacttcgatttgactattgacaaaacacagttcttaaagctttgaaaataggctgggcacagtggctcacgcctgtaatcccagcactttgggaggccacagcgggtggatcacaaggtcaagagatcaagaccgtcctggccaacatgaggaaacctcatctctactaaaaatacaaaaattagccaggcgtggtggcagatgcctgtagtcccagctactcaggaggctcaggcaggagaatcacttgaacccaggagtcggaggttgcagtgagccaaaatcacaccacagtagtccagcctgggtggcagagtgagactccgtctcaaaaaaaaaaaaaaaaaaaagctttgaaaatatcagttcagtaaagggtttcaagtcagaaaaggttttgaatctttaccttcaccttccttttgtgctcatcattgctgccaggacgggtttcaggtttggagtgaagaggtggttaaggaacttcaggtacttggcatttgctaatatgattatagggatatcagcaaagggttgtccctgtggccctcccctagaccacatcgtaacctagagtctccagatgcagtgtttttccatctcaattcacatagatatgttgagctagcacatttgttagaagtgcatcctagaaagattatattcacaaactgagcccttctactaccaccctttcccacaactggatgtttgcttggtctgtgaccttgagatccagctgataagatggggtggcaggaatcatcagggacaaaaattctatgggttctggactgactgatagcattgaacttgtacatgaaaggtattcaatattaacagtgattctgtgtcagagaagtaccagtaagccagttactactccttaggtagtgaaatgcaaggcaggtgtgatgggttttttttgtttgtttttgagacagagccttaggctggagtgcagaggtgggatcatagcttactaccacctgtaatttctgggtttaagcaatcctttcacctcagcctccctaagtgctgggattacagtcatgagccaccacacccagccaacactgtgttttggatacttattccaagtgttactcttgagttttttgttttttgtttttttttttttttttgagacggagtctcgctctgtcgcccaggctggagtgcagggcgcgatctcgcctcactgcaagctccgcctcctgggttcacgccattctcctgcctcagcctcccgagtagctgggactacaggcgcccgccactacgcccggctaattttttgtatttttagtagaggcggggtttcactgtgttagccaggatggtctcgatctcctgacctcatgatccgcccgcctctgcttcccaaagtgctgggattacaggcgtgagccaccgtgcctggcctgctcttgagttaaaggattccttttacatagctgttagcccagcaaatacttttcatgtttgcactgatgaattcaaatccagttgacctcatttttgtgacgtgtatcctaatgtaatgatactggctgcatcagtttcggtttctacttaatgcagaggcctttaaaaaatgacttagaagatcagtgttggttggtatcagtttcgactcctgtttggtcatcaacacaatttgtagatcttatgctcaagcttcctctctctcatcaggcagatataatttgccatccagtctacttgtgggcatgaaagtgcccttgacataggtggcttttggttgaaggcttgcagacatttaatatatatataaaatacttaactaattttattaaaatgaaaagttgtattcaaatgttgattttcatgggacaatttaaaaaccactgcctgttttccaggtacataagtactttatactaccatttcttttttttttttttttaactttgtaaatgtgatggaaaggctgaggtatatgttgttgggtaaaacatgagtgtttgttgatctgtttctgctgccgtagctgtctgatgtacagtaatgcgaaaccgcattacaggttatggctcagaatcttaggatttggaagctaggcgattaccctggctaaacctttcaggagccagatgttcctagtggtctgaggtagccttagggaggaaatgaagagagaatagaaagaggcaggcccacgcttaaagtgctgagagggaaaaggaggaaacaaactgatttttgatggagaagccagcaggaatcagcaggagaagctggagtatgtggcataactaaagaatcaaagccggggcgtggtagctcacgcctgtaatcccagcactttgggaggccaaggtgggtggatcacttgaggtcaggagttcaacctgatcacaagaggtcaggaggtctgaccaacatggggaaaacccatctctattaaaaatacaaaaattagctgtggtggtgcacacctgtagtcgcggacactcaggagattgaggcaggaaaatcactggaacctgggagaccatggttgcagtgagccaagattgcgtcgcttcattccccctaggtgatgcagtgagaccccacctcaaaaaaagtatccagaagtgaagctgaccttggggaaagaggaagtcactgtcactggggagctaagacagcagctctgtttttataatacaggttaagtattccttaccgggaatgcttggcactagaagtgttgcaggttttttgtttttgtttttaattttggaatatttgtgttataattactggttaaacatccctaatccaaaaatctgaaatccagaatgctccagtgagcatttcctttgagcatcatgtgagtgctcaaaaagttccaaattttggagcatcttggattaaggatactcatcctgtggtggtagtagtagtagtattgctgttggaaatgggagttggtggtttttggagattgcccttcagcctttcgtaagaaggagtttgcttttttttgagacggagtttcactcttgttgcccatgctggagtgcaatggtgcgatcttggcttactgcaacctctgcctcccaggttcaagcaattttccttcctcagcctggcgggagaagtttgttaaactttccgaaccccctagtgaaggacctctaaagaaatatgcaacagggtgaaccatagtcagtgttagacccagtcattgagaaaccagaaattattaggagaaaagataacactcctctgcagagagaaggcaaacatttgttgaatttacatttcatttcaagccctgtggtaaactccctaagctgcttgatttgcattacagggtgggaggtgtggttcaggtcagttgcttgggctggctctaactctcaaaggagaggtataggtttaaacctttagatgtccctgtattccccaggaaaagagactaaggacaaactcttggtttgttttgtttgttttgttttgttttttgagacggagtttcgctcttgttgcccaagccggagtgcaatggcacaatcaaggctcaccgcaacctccgcctcccaggttcaagtgactcttctgccttagcctcccaagtagctgggattacaggcatgcgccaccacgcccagctaatttttatatttttagtagagacgggatttcttcatgttggtcaggctggtctcaaactcccaacctcagatggtctgcccgcctcggcctcccaaagtgctgggattacaggtgtgagccaccgcgcctggccaaactcctggtttttaaagattgtgcttagtatagtaagtacaggaaacaaaggcatctggacaattggacaatcctcaaccaatccagagaaatttgttcttgcaaggtatgtgactaggttttaaactcagaacatcagtttcctgtagaaacagtgcatagaggcatatttctgtcagaactgcactctgactccagaatgtgtggatgcctgtgctgttgagggaacatgaccatcctgtgacatcaggcctgtgggagcatgtggagtctgtgcagtgttggaaacaaatgccctgtagtgcctgtgagaggcagccactgccgtgtgatcattgtgcctcctgctagagtactgagggctggggatcctctggtgtcagtaggttattgaggggcatatatgggggatgggtgctaactctcaggtttcctcagaaggaaggtcataacgccacatgtgtaagttcgtaattgaattcagaagtaggggactagctgcggtgagattggacagagcagacaatttcaaacagaattgatgctcccagataattcctgggatttgatggcagtccttaatcattatcaaatctggaattctggtttcatgcttctgtggaatttaaaaagatttcatgtgaaaatgtaagtcattgcttttagatcagatatgtgtctctcctaaaccccttccctctaggagagtctttctttaaagagatggggtctcactatgttgcccaagatggtcttgaactcctgggctcaagccatcctcctacctcagcctcccgaagtgctgggattacaggtctgacccaccacgcccagctcttattttaaaagagccttaaaataagatggttttattaagattcttaataaaaacatagtttcatttgcttaaaaggcacccagaatcttgctttgggggaagttaatcctgagagaatgagcctacggaacagtaatactctctttttaatgtaatactctctttttaatcacaggtaaaagaagatacaacattaaactatggaaaactttcacagactgttttaactgtttaccgatagcagccatcgtggatgagaagatattctgctgtcatggaggtaggtgggctgatttttgttccaaataggttttgatcccttccaaagggtgaacactttaacatttgtgagttatcattgggatgactttctctgacagaacactctcctttgttgatgtgttgcattgcactttcactctgatacagccaggatcatttggataaaaatcttaaggaattgatttattacagggaattctagactctgtaagctaggtttgaaaatagagcagaaaatttttatttttattttattttttgtaaggatgagttctcaccacgttgcccagtctggtcacaaattcctgggctcaagcagtcctcctgcctcggacttccaaagtgctgggttacaggtgtaagccactgtgcccggcttagaaaagtttttggttttttttgtttttgtttttgttttttgagacagagtctcgctctctc

SEQ ID NO: 8700 - DNA, 1219 bp, Homo sapiens
ccaggtcctgaaatgacttaagggtgttggggggcttataccccaggtcatggggcagacagcaccacgcctccaccccccaaccccggcctgggtcccctgagctacctaggcccatggagagacctcatctgccccgcactgcccaccccagccactgcacatccctctcaccagcctgagcccctttaggggcaggaaactcactcaccgtcaccagttctgactgagagaaagatctccctcactacccgagctctcattctgcctgctgggcttcgcagaaggagtgggctccacctccctgggagacccagctccttcccactcggaggtggggcctcaccctgcctctgctttctcccagcgctaaaggctacgcaggcagagctgctagagctgcggcggaagtacgacgaggaggcagcatccaagtaagtgagccctgctgaggtgtacctcctcccttggaggcctcccagacaggcctcctccttctgaccctccagtacttgcctcctccctctgaccctcccagacacacctcctccctctgaccctccagtacttgcctccaccctctggccatcccagacacgcctccaccctctggccctcccagagaggcctcctccctctgaccctccagtacttgcctccaccctctggccatcccagacacgcctccaccctctggccctcccagagaggcctcctccctctgaccctccagtacttgcctccaccctctggccatcccagacacgcctccaccctctggccctcccagagaggcctcctacctctgaccctccagtacttgcctccaccctctggccgtcccagagaggcctcctccctctgaccctccagtacttgcttccaccctctggccctctcaggccttctccctctgaccctcccagacacgcctcctccctctgacccttccagacaggcctcctctctctgaccctccagtacttgcctcctccctctgaccctcccagatatgcctccaccctctggccctcccagacaggccttctccctctgaccctcccagacacgcctcctctctctgaccctcccaaacacgcctcctccctctgatcatcccagacacgcctccaccctctggccctccagtacttgcctcctccttctgatcctccaggacttacatcctccctctgtccctccagacatgtctcttccc

SEQ ID NO: 8701 - DNA, 1613 bp, Homo sapiens
ttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtg

SEQ ID NO: 8702 - DNA, 1430 bp, Homo sapiens
tgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgatcaagttagtgtgtgtctgtataagctacttctttgtaggatacttaatatcaaagcaggtgtgctaagggtgcattttgaatatcccggaaggtagctgtgaaatgatttttcttcttcacccttagttctggttcaaggtatctctagaaaaagac

SEQ ID NO: 8703 - DNA, 2030 bp, Homo sapiens
tctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcatcagctgctgacaaaggtccctgcactccagggcccaggggattgtcttaatgaggagaaggagctgcactgaagttgggctctaacgctggccttgaggccctccctggggctgttacgggtgaattggctgtattagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggaggg

SEQ ID NO: 8704 - DNA, 1498 bp, Homo sapiens
tatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacatcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaacc

SEQ ID NO: 8705 - DNA, 1115 bp, Homo sapiens
aggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgct

SEQ ID NO: 8706 - DNA, 1192 bp, Homo sapiens
tgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttat

SEQ ID NO: 8707 - DNA, 1181 bp, Homo sapiens
gttgttgtgtgacctttggttggcctggtgtttcctggttcctgttgatccatggggaaaagtcctttgccttatcaaaatatttatattccttcagcataagagtgaaattaccttcttagtactttgagcttttcctttccactttcttagactggctttttaggtgcccagcaatgaatatgaaaaactgacggcagtgtttgcattcaggcagtggttgcaggaatccagcaggctcacgcggaacagttggccaacatgagaatccaggatctgaaagtcagcctcaaacccctgcactcagtgaacaaccccattctgcggaagaggaagttacttgggtaactgagcttatttcttcgattcttcttcatggctggaatggctgagtactgggttctgaaatttaagaaatttaacttgctcagctaggggtctttagcctctgaagagggtggagaggataagttctttaaatagtatcaggagttggacactattgttatttttctgatacatctgttgccttatgtttagaggtaatatctgtccagagttggtttttggggtctcacgttgtcattacccctccctcaaactcttaaagcaccaagccaaaggacagtgtctatatccacgaccatgagaatggagccgaggattccaatgttgccttggaaaaactccgagatgtgattgctcagtgtattctcccccaggctggtaaaggtcacaccatttactaatcctctgtgtgtctgtgagtgtgtgtgtgcaggggtgggtgggtgtatgcatgcacatggcaaaaggaatggtttaattttgggttgtctgtttcatcttgtgttataagaaaagtacattatataaggtagtctatgcccactaaaaagattggacagtgggagcttagaaatgcagttaagttctgcccctcctttgtttctgtggaatttctagtttagacttaattggcagtgtcaggtgcaagcatgcaattttgtgttttcttagtttgacaacaagggcacaggttgggggatggagaatggaaaatgtgggtagggtctgaatctcattgcaggctgttaaccatttccagagcctttagagtgcaaggctgccattagctcataaataagagaatacctccttagttcagaagtggctcctgc

SEQ ID NO: 8708 - DNA, 1160 bp, Homo sapiens
gcctggccaaaaagctcagggaagccgcggagccactgcccgcctgggtcagggtggtgacggagcctgactgagaataacggctgaacttgactaatagactgaccgagggttggagcgggtcccaaccaactgcctgacggcccaaaggcaggaagaaacgatggtaggccttgtcatcttcgaaggagaggaaggacagcaaacgaattgctatagcgtccccatgcgcacttggcgcttctcctcaagcggagcaggaacggaactgggcggacccgccggaagactcggcgagtgcgcgcgcgcaggagcccattttcccgcccgcaacgtggccccgcccttttacccaggccctacgcgagcttcgccgagtacgcgtgcgcagcagcttcccctccctcgccccgcccctcacgtggccccaccctctcaccctagacagatgggagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtaaccggggcgggggacgtcgcgcgcaggtgccgccggggcgcccggaagagcgcgcgcccgtggggagacgctggattccgggagctgacgggaggtggtctgtagcaacggtcccagagcttcccggcgtcctacaggcctagtggactctgagcggagaatgttatgaccaccgggcatgcacgcttcagggccccggcgcacccttgcttttgcagcatttatacttgcatccacccttgcaaagatgcagccgagggaactgggtgccccttcccttcacctgtggggagagggcggtgcctggcgagatccaaccctcgagtcccaagtgggagaaccggagggcggtgcgaggtcgacgccaccgggctcccggctgtggaagctgggaggggttggcggggggaaatgcaggcgcgttagcctgcgtgtccgcgccc

SEQ ID NO: 8709 - DNA, 1363 bp, Homo sapiens
acatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacattcacatcttttcttcagactcagaagcagttatctgcaaaagtgagcttcacgacagctctactttcatatttaaccatt

SEQ ID NO: 8710 - DNA, 2359 bp, Homo sapiens
agaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgtatctacaggcttgttattgaaacttcctacttatttgatgtgatttattaatataggaagtatatattcttccttaagtaagtgaagcatagcaaatctactttaaactggatgggttaatttatataaacattttcattttaagttggcatttctgcctggttcctttttgttcagattcttagaagccacaaccttctgaatggtgtaattcatctcagttgtgaatttagggctatatcccaacatatttttaatatttgagaatttagaatttttatttgaagtcagctagtccttttgactcaaaagttagtaccttctgtacttgcagttattaattcaacatatatgtattgaacacttaaattagcatatagcagat

SEQ ID NO: 8711 - DNA, 1106 bp, Homo sapiens
agtaaaataatctttaataagatagtagtagtttgtatgtaatagtggtcccattttctaagagagtgaataagaaaatgtgacatttaggccgggcccggtagctcacagctgtaatcccagcactctgggaggctgggatgggtggatcacctgaggtcaggagtttaagaccagcctggccaacatggtgaaatcctgtctctactaaaaatacaaaaattagccaggcgtggtggcagatgcctgtaatcccagctacttgggaggctgagacaggagaatcgcttgaatccaggaggtggaggttgcagtgagccaagatcgtgccattgcactccagcctgggtgacaagagtgaaactccatctcaaaaaaaaagaaaagaaaatgtgacattttccttcttgtggttggactctattctggttattgagcagaaatgaaaccagcttaccaacttttataacttttgattttagagaagttgacaagtgagattcagagtcgggaaaataaatgcatggctatgtacaagaagctgagcaggtggccagagtgcaatgccctttcccggcgcctcttactaaaaaagtgagtaaaagctttcttttgtaccatttgactgtagtgaggctttaagacctcactattgattttcttggtgtctgtgttttgaagtttctgggcataaagtcttcttatagtagttgtgtcctgcatgtttctaaaagtttttaaggagccttcatctttcagtagagtattataatggtacttgtaggctgggcatggtggctcatgcctatgatcccagcactttgagaggccaaggtgggcagatcacttgaggtcaggagtttgagaccagcctggccaacatggcgaaaccctgtctttactgaaaatacaaaaattagctagttgtggtggtgcgtgcctgtagtcccagcccctcgggaagctgaggcacaagaatcgcttgaacctgggaggcagaggttgcagtgagctgagatcatgccactgcactccagcctgggtgacaacaatgagactccatctcaaaaaaaaaaaaaagatacttgtgccaccatggtgctgaa

SEQ ID NO: 8712 - DNA, 1143 bp, Homo sapiens
tacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtat

SEQ ID NO: 8713 - DNA, 1098 bp, Homo sapiens
cggggccggcacatccttgtggcgtgagtgtgtgcgcgtgtcaggggctggcaggggctggcccggccagccagccagggtatgacagcagcatctgttcctgggcaatgacacgaggacctaggtcaggtgacaggtggatttcaccaggagagggagatgaggcaggatggtgggtgccaagaaagagggtcctcagcagaaggggtttactaagaaaacagcagctctgaggcggcggcaccagaggcaggaaaggactgggatgaccagggcggctgggccccaggcctctcccaagagaggatccgggacctccagctgagtgggtgtggcccccagacccagcctcttcggcggtgttctccctcacctgtgctcctcacccgggcaggtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggtagacatcccagggccaggctgggcggggaggtggtgagccccaggcgtgcctccctgtcaccctcaactccagcagcaggcatcggcagtggcctgtctcagctctgtccttgccacagacctgtatcattgtcatcattgtcatctccctgtgctcacagcccacacgttgcaccctgccccaggattgggcctggcctgcagaccccagggctggggaggcactgggtaggtggggctccagggctcctgacacctggacctctcctccccaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggtaccgcc

SEQ ID NO: 8714 - DNA, 1227 bp, Homo sapiens
tttttaattttaaaaattggattttttgctttcattatccagagctagctatacaaaacttttctcctgaaagacacttaaggttcctatgtaaatttcttattattgagttccaacatgactaaatgcagccattagggttatattacattgtgaagatacagaggttcaaagaaaaataaaaggtccctaggaaattacttacatatttggcagaaatattttgcatatatacatttatttcctctcttgggtcacttagttactaatttgaagatgtcaagcattcattgaatccccttaggacaaaatacatgatttttttccatcatggcaacattgagttgattccatcgatttttgctgtatataaacaaaccagaatttgaagttccttgttaatgaagggaatcatcattatcagaaaatcattttgtgtttgattgcacatggcagtatcctaagttgtagggaaagagctgcaccagcatgttttatgcccctttgaacctcacatgagagtttcctgagtgtcggtcagttacgtttatctagtgtaatccatgaccctttgtcaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtgagatgccagactcctttctagagctcactgatttcttctattggtgtgttagtttattggtttttttatgctaaatgaaagagagaaagcctctattaaatgacatgatcagatgggttaaatcagtggatgatttcatgagagacttttcctcagtgtggttttataaaaacttacagcattacgatgagactgaatgatatccctgtaccctgaaggagtacagtaatcccaggaaattgagaagatattttttattctctccttgtcaatactgctagtagtttccaaatatatttttttaattaaaaaaaatttattagacacaaggtctgtcacccaggctagggtacagtggtgcaatcatagctcactgtaacctcaacctccctggctcaaatgataagagatcccccgaccacagcctcccaagtaggactataggcgcactcaccatgcct

SEQ ID NO: 8715 - DNA, 1164 bp, Homo sapiens
caatcttaaagatcctttacagtatcttttttttttttctgagtacctttaaatgagaattgatcaggtcttctcttggatatcaactgggcttcgcccttgaaaaaaagagggaaaaatgaaaatatatctctgcttcttgtcctggaaaaaggcaaaaaagaaaaaaaaaagcaagtataatatctgacaacaaggaaagaaaaaacccttaaatgtaggaatttttaaaatgtttctgattgccactgatatcaagcatttaaaagcctcagtgttatcatactgcatgctgtggaaaattaaagagcaatttaatgtttacattgtttttcctttccttggctgctaagctaaatcactttctctttttctgtttagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaagtaagtaagaactgggttactattggttccacctcgagtaagctgattcttagatgcttcttatttttctttgctgctggtcaccattcttgactgatttctgtctgcagatatctctaaggagaactttcctaagataaagttcttatctttgaagggtagtgattgagggagttaaagaaacaccacctctgcagtctaagaacaatgttttaatgatatgttgaaagtgtactttgtaagctttcaggtgcttagatatatgagaggaaggaaatgttccttttcattctgcttaccccctgccctccctccgtgcttgaagttaccccagatgtgtgatgtccattcatctagaaaggtctcactgcccaattcttggggcttctcatgtatcttttgggaaaaggtggctttttagaagggtttcagaggtgctaggatctggtttatatttatttaaacatttgttctttttttgaggaagagtagtttccaacctggtggcttaacagttatgaacgaaaggaagcatcttaggggttgaagcattttcttctacttagaattgttgaattgtaacc

SEQ ID NO: 8716 - DNA, 2719 bp, Homo sapiens
taaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggcagagaggctgggatgatggagaaagctcgaggtgaagttttaaaaaaaaagttgtggaaaggaaagttccaaagaggtggtttctgaggaagtcagagcgcccagggccagagcagtcagtaatgggtgaatgaggttgtttggaaagtcggtgtgacagacacatggatgccatctacttctaggttgctgg

SEQ ID NO: 8717 - DNA, 1124 bp, Homo sapiens
cagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaaggtgagtccaggcctgcctggccaggggaggggtggctgaatgtgcaagagttgagattgagaatgagagagagagagagagagaagcaaaaacctagaacccagggtgcaaatgtgagtacagagagctgagatcttctgggatggtggtttcttatttatccacacagcatgttaaaatagattctggggtgaaatcctacatccctattattaacaagtgaccctcccccctacttcccgctgaagtttatgaaccactgtcctgggcgatgcccatttcagaaatagggaactgaatcccagctctggtaaacagtttgctaattcgtggccaggctaggggctcaccatttctgcagtgaagaatcatatgttttgaaagcaaatagcacctgctggctgcaagaccttgagcaagtcacttaactactctgtgttccaatttcctcagccataatccccaatactgttgcagtcttgccagtgcaccttaatgtagcagcttctcactgaattagtacccaaggttctttgtcctgcatccaagaaaattaaggaacatggacacaaacgtgagcttggagcaaaagttcagtaagcaaaagaagaaagctgtctccactgtggagagggaagtctgagtggattgccagattgcagctgaatgcaaaaaacttttataagaaaccactctcctccctgtaactgtttgagaaactttttatcagtaaagctgtgcaacttcccttaccttatgcagctgtgggtatatctctaggcaagcataaagcgctgcttctcttgtatgtataactgtggatttgttttaggtaagtcccactccctgcgccagtttcaggcaggccgctcctccagggcccagccttgaccatttacctaactgatttttcctctactttccctcaatacctcatagggccgtgtagattaag

SEQ ID NO: 8718 - DNA, 1098 bp, Homo sapiens
acaatgggaaaagaacacagatcctggaagaaggcccccaggtttgaattgtatttgccacctactagctgggtgatggggctgatatattatctcactgagcatccattttcccatctgtaaaatgggaactaatgataatggcatccaaatcatagcatcattgtgagcattataggagtttaagacatgcaatgccttcagaacagtggctagtgctccataatgttagtgattgctcctgtcattttatttagggaggtttgcctcactaagcatcaattattatttttgtcgtctttttcagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggtcatgatctatcacaggagagacattaaacagcaaattggcataatgtggggacaaagacatttcttacagaacatctgcaaggcttactggttctgtttaaggcaaaatgtgtgaattttatctttctaaaatcaggcagcaaagatgtggcttaaagttcatgttactctcatctttgtcccaacatgagatctcatcaaacgtatgcagcacgttgggagatagatatttataatttgcaggaacatttggacaggaagtgtaacctctcagaggctcccttgccacatcaggagaattggtaaaaccacactacctgtatcatatcattattttaagtgataaatgatc

SEQ ID NO: 8719 - DNA, 1321 bp, Homo sapiens
agccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaagaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctcctcgcctggtcttttcctgccaagagaggggtgggtggctctgttcctgggggctgcagtcagccccgttggggagtgatggcttgcaagagaatgacttcagggtccttgcctcgggctggaaggggtgggggcggtgaagcagtggcagaccctcctagtcctagtctccaagaatgcagaggtgaaagtgcccttctctttcacaagagcacaaggcaatgcacacatctgctccctggcacaatgacaagaaacaaggaactcaggtgcagagctgggagcctcgagggaaatacggaggagctgggagacactgtgatcagctcatcaggatctcagagcttgtcagga

SEQ ID NO: 8720 - DNA, 1281 bp, Homo sapiens
aacttcttgcccacggtccaagaggtcacagctgggatttgaaccccagcggttctggccccgtgttattgaccactccatgaggctgcctaaaactttattagccacctactgtgtacagacactgggccacagcaataagcacagaacaggagtaggggcaggggaggagtctgcaagcttctgggaggaggggatcttgggagtgatcccaacagctgagctccctgaatccctgtcccagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggct

SEQ ID NO: 8721 - DNA, 1275 bp, Homo sapiens
aaggcagtggggcccctttccgttggtgcctgcctccctgtcagctacacctgggtctgttatctgaggacatggttcactgggtttcacttactccacacacagttaacaacactccctctgtgcagctgctggggtcaccagtgaataagaccaaaatagtaatttttaaacagttgtttttttagagagagttttgctcctttggccaggctggagtgcaatggcatgatcatggcttactgcaacctctgcctcctgggctcaagtgatccacccacctcagcctccgaagtacctgggactgtaggcacaagtcatgcctgaccatgccagctcattttttatttattttaattttttttgtagagatggtgtcttgctgtgttacccaggctagtctcgagtttctggtctcaagtgattttccagccttggtttcccgaaatgctggattacaggcgtgagccaccatgcccagtttaaatagtaatctgtaaagaacagctagcactctcatgagtgttccatgttgagactctgttctcagcactgtatatactgactcatgtgatcctcataataaggcacaaagaaggggcagttattcgtacagatgaggaaaatgaggcatagaaaagtttggtaacttgcccaaggtcacacagcttgtttgtagcagaatccggataaggcttgtgcactgaggtggcatttgcagcttccctgagagggccctctgcacacatcatctctgatcctcagacaaccctgcagagaggtgggaggtgttgtaagctccattcctccccaaactggcatcacccagcaagctgggattcagaccaagggtgccagactccagaacccgtggtcttgtctctgcacctcagtgcccgtcccccgccatggtctggcttcctttcctttctcctccaagtctccttctcactttgctaccatctttgctctgagcagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggtaagcagcccgtggctggccctggggcaggcaggggtgccggatcctggcagaagccgagggtacaaggcttaactcttgacact

SEQ ID NO: 8722 - DNA, 1276 bp, Homo sapiens
gaggctgcattgttgttgaggctgcattgttgtgttggccacagacggggcggggcctgtgacgggcagtgactcagcctctctcccctcattcttccacagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctctt

SEQ ID NO: 8723 - DNA, 1170 bp, Homo sapiens
gcttagtgggctctgtaaaatgtggtgggcaagcctctctacgtctcaaactggtggcccagaggccaagtccacccctagaagtagagtttgttttgttttgttttgagggcttctgcaatcccgcccactgcccacttcccacatgtatctcacccacctgccccagaagcctgagactctgaatcttggctcaagtcccaagtcccttgcagccctggcattctggcctcaggctgggggccaggtgggactgggtaggttttcatgggttctcaggaagaagggcgtatctgatctgcacgctgaatgggcagggccttgggcccctccagcgagactgtgcagaacatggtttctccgtcagcttaactttgctgccgggaggcaggaaggcagttccttaactagagtcttccagccccttttgctgtgtccatgggttttcagtaatgttgtccccctttctcactcccaccttgcaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagacgtgagtatcccggtaggaacctggggttgagtggggctgtgttcctccaatcgataaatatctattgagcatctactatgtgccaggcactgaccgcagcctgggatataccggggaacaatagagacaaaattcactactctcaagaagctgacagtctcctgaacagacagatcaagaagtaaacttatacactttgggaggccaaggcaggaggatcacttgaggccaggagctggagaccagcctggccatcgtgtcaaaaccccgtatctactaaaaatacaaaaattagctgggcatggtggcaggtgcctgtaatcatcagaaccctgaggcaggagaattgcttgaaaccgtgaggtggatgttgcagtgagccaggattgtaccactgcactccagcctgggcggcgaagcaagactctgtctcaacaacaaaaaaaa

SEQ ID NO: 8724 - DNA, 2012 bp, Homo sapiens
ggctcatgcctgtaatcccagcactttgggagcccaaggtgggcagatcacttgaggtcaggagtttgagaccagcctggccaacatggtgaaaacccgtctctactaataatacaaaaattagctaggcgtggtggcgggcgtctgtaatcccagctactcaggaggctgaggcatgagaattgcttgaacccgggaggcagaggttgcagtgagccaagatcacgtcactgcactccaacctgggtgacagagcagagactcaaaaaaaaaaaaagtgacagttcagaattgggctctggggtcaaggtcagggtgggaggctgggtgcctggattggggcaggccaggacccctgctcagctgcggctctgccctgtccccaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcacccatcatccatctgcacagccttccacccacccatccgtcttccatcatccatccatccatctacctatccatttatcatccatccactcacccatccaaccacccatccaaccattcagccatctccatctgtccattttctttcttcttcttttttttttgtttttgttttttctgagtgggagtttcactctattgcccaggctggagtgcaatggcataatctctgctcactgcaacctctgcttcctgggttcaagcgattctcctgccttagcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgaga

SEQ ID NO: 8725 - DNA, 1200 bp, Homo sapiens
agttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgag

SEQ ID NO: 8726 - DNA, 2090 bp, Homo sapiens
agtccatatctagaaggaaggaggaacatgagacaaaggatgagggaaagagcctggggcaagttaaggaatgcctttgagacctccttcctgctaagatctggaatgtattagaatctgagaaccagccttccctcttgaggctcacgcccctgctctgtgtgttctctttggcaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatct

SEQ ID NO: 8727 - DNA, 1096 bp, Homo sapiens
tcccatgatgactgtggaatatatagcttctcattttttagggcaggcacatggaatcagtctgaaaggagactatcacaagtgattgattttctcttttcaaacaagcctctactgtagaatttataagttgctccatgtgcatctccatgtttgcagaatacataagcatgactgtggagatagtattttgggtattgtaatcagagtattgcagcctgaaagcataatgtttttacaagtgaccattctagattctggttcagtccgacactgcagaatatcactaaagtcacctctttgcatgtattctttcagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagaggtatgttattcactaattgagatgagtggcttcagctcagaccctttctctcttcttcttctgcaccttttctcccttgacctcatgattctgtgaatcctatgaagtgctctatttctcttctcaaaagaaaggggcaatggtcgatctaaagctgcagtgttaaaaatttgagacttcttataaattattatgaattataaactttattattaaacttacttactatcaacttaattagtaacaactttgtacaacataaccacagaaaagaaaggggagttgaaaaagatacctcccattttagaggagtacattgccattttccatctgccctcgatgctctctggcttg

SEQ ID NO: 8728 - DNA, 1532 bp, Homo sapiens
cagtgatagcagaaacaaatgataagaaatacacagtacatggctggggtgatcatgtgtctagttcagcatctgtgacatgctgcccttcctcacttggtgccttctctttttgtagtaacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatggtaggtgtcccagaacacaaatttactttgaggagtatcttggtatgatcataacttaaaagctttctttactgtatttgacaaaaaattttaatttcatgtctttcgggggaaaaaaaagaacctaaagtgagagctgtattgattttatcctaaacttatggactgggagaatgttttatattgaaatgcctttggagaagagtaattgttttctgaaattttcctcttgtaactcataagtaagcagtctatgttgggaacctgtgaccgctgagtatcagagtcgtcaggagcttacagactgataatttgcacactcttgcatgcttaaatccaccattcttccagatcaagtttccaaggaacctcttccatgaagccttctagccatttccagagtctcttctcccttctctgttttccccctttgttgtatcacttataacaaaatcacattttactttgcattgtgg

SEQ ID NO: 8729 - DNA, 1204 bp, Homo sapiens
ctccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggtagttgtcaatatattaacatttccagggcagagcagtttccaagtggattcacatacatctgctttaaaatggtattgtctgtgtgccatatatacataagttcctaagaatccttttaattagaacatgaggcacaccagcaggcatattaaatagtgtcttttgattgatttaacatttctgcattagcattttctaatgatcataggagagaaatactgaaatacgatcattttggttgctgtttttatgatagcactatgccactgtggtgtgttctacagagtttaccaatattaacactgaccccactttgttgtcacaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaagtatgtatagggattgtgtcatttacttgccatatttgatgcaatttttatcttaactaaatgtttgttaaaaatgatgacaaggtccgggcgcggtggctcatgcctgtaatcccagcactttgggaggtggaggcgggcagatcacttgaggtcaggagtttgagaccagcctggccaacatggtgaaaccccgtctctactaaaaatacaaaaaattagctgggcttggtggcaggagtctgtaatcctagctactcgggaggctgaggcaggagaatcgcttgaacccgggaggtggaggttgcagtgagccaagatcgcgccactgccctccagcctgggcgacagagtgagactctgtctcagaaagaaaaaaaagaaagaaaaaatgatgacaagtagcatatcatttgaaactttcctttattggtcgttcatgtttttgtgcaaattattttgtgctggaaaatgtgcat

SEQ ID NO: 8730 - DNA, 1195 bp, Homo sapiens
tcatatttcacactttgggttggtgttcatgtgttttgtttggctgaatttattatacagtcagaggatggatttggtaccaaggatgtcactacaccaggtcattccacgccggtgcctgatgggaaaaatgccatgtctattttcagttctgctactaaaacaggtgtgtacaatgattatttgcctcacttggattgttgctaaaatgaaatgcaaaggagatgcttctcaatgtaaaattttattcttattgtaataagaatttcatctcatctttaatatatttttcatagtttgtttttcagttcctttcaaaactgataaacatatttggaaataattgtctctaaatttaactaaaaccatagggaaaaactcacaggcaggtcatgttcattgagatccgtgtcctctccctactcctttgcgcttggtggagttgtttattctgtgtcttttgcctcctttcctacagatgtccggcaggataatgctgctggcagagctggctccagtagccttacacaggtaacagatttggcaccttccctgcatgacttagacaacatctttgataattctgatgacgacgaacttggggtgagtttgccgtagctacataaacaaaaatttcgctacatgaaaggactttatatcagtgttgtagtatttctttatagtttggtgtcctgaatttgggggctcttatttcaggttctgaatgttctttataaatgtctgtatactggaatctagtcatgctgtataaaaaaagtttgtatacttggaaaagattgtaaaggttattagtgtagtgtatccacctcgagttttgttcattgaaggatctttttcattagtgtattccagttgtacatattaaaatctctcacatttattgtaataaattcttctaaatatcacaggactactagaaatgtattacattgtcccttaggtttgatttttaaagtaatgcccacataactttttattcatctaataagtcagaggttaggtatgcaaatatgatttatactttttaagatcatggcatcattgtaggggaatagaatttatatacatagaagttaaatactacaaggcagcatacaattaaaatgacagagaagaataattattataattctttggagatcagcagaactaagagtcaggaaatgtgtgtcct

SEQ ID NO: 8731 - DNA, 1210 bp, Homo sapiens
aaattcaggaaataaatttgatgttctgggaagatgtaatttcctgacagtctctaaaatcatgtcctttagaccttcaaaacatgtaaagacatttgtgtaaatctcacacttttggaatttttttcctcttgattttccctctaaaaaacattttataactttgctattaatttgtgacattctttttacctttcaatagaactttaacaaaattagtctttgcgatactcttaaatagattaatttgagaattttaaatgattttaaactttgaagaagcagattgtaaagacatttatgggaggagtgttacaccatgcctcatatttcagactttaaaaccaagacacattacttttttttgtacgtaagtattttctaactttgggcaaatacttaaattccactctctgtttcagcgtgagattatttaagtcatttaaattaactcatgaactttgctttagaaaaatgttttaaaagtttctttttatttggatgtcctttttactggttctttttttttcttttttcttttttttttcagttgtggaagaaggactctgggaaaatggcctttcctatgaatgtaggacgctgctcttcaaagcgatccacaatctgttagaaaggtaagagaaggaacagcagacagtggtttgcagacaaccaagtatattgctagataccgagagtttcctgtaattttcaaaaacttttcacttgcaatgatttattgctagtatgaaaattacataaatctttagtttctctttctattgatataatttgaaatttagggaagttttgggaatggtacaaagaactcccatattccctgcccttcaacggtagtttttatttttaaaatttattccctaaatcatttgcatatttgtaaactcaagattgatgttcttttttacccttaagtatttggtgtatgtttcctaaggacaaaggtatattagcacagtatcatgataaaaattaggaaatgtaacattgataaaatgccattatctaacccgtagttcaattcagatgtcattggttgtcccagttacatccattatagcttaacctcctaagattaatccatgatcatacattgtatttagttttcatgtctctttaaatccagaacagttctttagccttttttttctttcttgacattgatatttttgatgagttcaaaccttat

SEQ ID NO: 8732 - DNA, 1381 bp, Homo sapiens
gttaaaaaacatgaataaattgctgataactttgtatcagttttcttaattgcttctacctaaatagacttttggcattcatgatgaaacactctcgtacttcatgctaactgcttccctaattaaaaaaggacttaaactgtggcttgtggatgggaagaaattatttgaaagaaattatttcatatatacaaacttatttttaaaatcttacttgatttctaaatataatttgtgagttgaatattgaatgataacatagaaaatagttttctgcatagagactttatagtaagtgtttagacaaattaaattattcaacaggaaataatgattatcagcttgttttattttagtatttaatgtaaagagctatgtagaaatcttgatagaaagtttctcccaccttaaaattcgagaagattgacatacattcttcactgggaggaatcttatgatatgaagtttcgtgtaaatatttattttagcacaattgcttttctgtatggaagactgtttttagtggtctgtaagtaaaatgagaaaacgattacaattttttgtctttttccaggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcagggtaaggtttctgtttttttcttaaaaattatttgcatcatatttttttgaacattgataaatttcaaacagattattaagacttgtctaaaagaacgatcttaagtgtttcatggatgtctctctcaaaaggaacattctcacccctcttcctcccatccctgtttttttttcctaactcttgtccttttccagttatgctgagaatcagaaccttgtgaaccgctgctgttaaatgagagtattgtgtctcctgggtgcggtggggtggaaaccaggctaagatccactgtttttaaatgatagtgaattgtgagtaactaacaagacagtgaattgaacagttactgtttttttccttggactgtggttgttatggttcactgccagctgaactctttggtggaaaattggagagtgatacagaaatttagttttgagcctaattggacaaaattgtgagattacattgaatagtattttgaggaaagatgaatatatgggatctggtctgaattgggtgtagcaaattttcttttgcttttatttctgtttttcatgtaatttggt

SEQ ID NO: 8733 - DNA, 1124 bp, Homo sapiens
attgacaagagcactgaccttaatgaccttgagtaaattaccctctccggctttggtttcctcatttgtcaattaagggtgatggctagcgtatcttgcagatccaaattccaatttttgtaacaagccaaaagtccccctggctgttaaagcaagaccagagccctcgtatcccagcggctgggtcccaggcttttgattttcacaggacaaatgtagcccagccatctggagcccgtttttctccaaaccagggcttcctccttctctcttgcagatttcaactggggctcaccattttctgcctcttcctcctccagttttaaagagacaccatatccttctctgctgggaccaacttcccatgtactgctgccctgcacctgtgaaaacagctgctgtgttttctgtcataaaaatagctgccttttggcagagaagcacacaacggtactacgtttctgagccttaatgcagtgctcaattatttaggtgtgcttcacctgagatacacagagcatcttggaactcctactaagcagggcttctacaggcattgctcagctcagtaaaaggttttcctttctctgcttttgtgattaccaggcagaaaccttaaaatgtatgaacttacaaagaaattaaattgtgccaaattagattcccagcccctagagataaccactaattaaagttccgctggagcgttttgcctgtattttgtatataaacgtggattttgtatttgtatgtaaataaaggtaggaccctgctgtccatattattttaaaataattagctcctgttagattgatttaatccaatgatagcgaattcatttgcagagcaggcaagcgcactttccacttctatcatcctgcctggaagattgaagcccagttagaggttaaaaccctttcataattgcacaggagtttagctttgcctgctttttccttgtctgattttatgcagtggggaaggaagtctttttgttctgcacaaataaattataggcatttgtcgcggccggagttgacctgcattagggatgctgaagaaacctgtcacggcagggtgtctctcggcgtgactcgactttcctgagagagcagagatcggga

SEQ ID NO: 8734 - DNA, 1124 bp, Homo sapiens
cttttcccgcctgtgacgtaaattcagatgagaactcatgctggctcatctgcaagcttcctgatgctttgcgagctttcccattcattccaaatcagaagcagtcagtggccccgtggtttccagacggctttctctttgttaagaaattagaatacctgatttccctgcgttttccttgtggcctgagtgtgcaccttggcttgaggaattcgctggatttccttctctcttcctttgcatttctttttggcactcttaatagccatgtccctatactatcagtaacctgaaaaagatcaggaaattaagtggcagaacatcttcacgggagctcagtgataaggatcatgccctccacgatggtgaaatgaaagtatttgatgtcggcctggtgtgtggaattgtgggcccacacatttctcttcctctctcagatcctggtgtatagcctggaagcaggacgccgcctcttgaagctgggtaacgttctccgtgacttcacgtgtgtcaacctcagcgacagccctcccaacctcatggtcagtggcaacatggacgggaggtacgtgagttggaagggcattgccttgcagccccatggcttctgccaaggcccggcccccactgcgctgctcacactgcccggttctcactcaacagctctgcccacctgagttcagccccgatcccataaacactctagactcagagaacaaagtcctgtattaggtaatagttggatgtagctatgtctctgcttcatttctgaagcaccacgggaaggttttcttttaagccatttggtggccgcagttggtagaaggtccagggagaccacttggaatatcttttgtcccctgctgcaaaatttgtttggcacttgaaagctcactttctaatattaaaaacagtaacctaagggatgaatcatgttcagcaaaatagggtttcctgccaaacgatgtcaagagtgtatttcagaacacggtggtgtccctctggtgatggaaggaaagagagacttcatgtgaacagattccactttctatttagctgattagcagccttctctttaatgcactggcttagggagtcggattttcccggtataggggcctgtg

SEQ ID NO: 8735 - DNA, 1153 bp, Homo sapiens
cctagttactttgctctcaacatttaaaataatgcagttgctctagtgaatggggcgttaggggcctgtctctgcacctgtctgtccatctgcatgcagtattctcacccatgttgaatgcctgctgcttgtttaccctttggaaaccctggggtgaccaaggtttggaaagccacctgagaccacttcatagcaagggaaggctttaagcagttactagaaagagatggggatttggcccctggctcctccagcctgaatgagctatttaatccactgtccatgttcctcatcagtcaaatccaaagtcaaaggatttgaacctgcatctggaaacgtaaccactcacagcacctggcccgccaaggttgggaggattgtacactactttcatttaaaggggaaagtttgataatacggaattaattaatatgaatgagatgcattaataagaacctgagcatgctgagagttgcaattgttggttttctggtttgattgatttccttttttcttagacacatcaaagtcaagaaagatggttttacctttactgacccagctgtacatatgtatctagactgtttttaaatgtctttcttcatgaatgcttcatggggctccaggaagcctgtatcacctgtgtaagttggtatttgggcactttatatttttctaaaaacgtgttttggatcctgtactctaataaatcataagtttctttttaaaaattttccaaaacttttctccattttaaaaagccctgttataaacgttgaactttcacaatgttaaaatgttaaatatttggatatagcaacttcttttctcttcaaatgaatgccaagatttttttgtacaatgattaataaatggaacttatccagagaaaccacgcaaatggcctgcccaatttcgtttgaggacagaaagcccagccatgacttgagtagaatgtctctcacctctcttcggatctaaatatgaaaagtatgttctgctgaatttttctgagcattggtgagcggacagcctacctgtaaaccatgacctccttgccaaacgttaattttatcagctcactagtaacctttgagaattatctggttgtcatgcaaagattgcactttctgaattatgttaaaacacatgt

SEQ ID NO: 8736 - DNA, 1181 bp, Homo sapiens
agggtaaggcttgaagcagcttcactcacagatgggagaaaagcttaggccttggcattgaagatgcaggaattttcaagtggtcatgatagtgatagctcttgtgctgtgaaatgaaaggctaggaatggtgacacaaagcctttttggaaatgcatttggggctgggtgtggtggctcatgcctataatcccagcacttttggaggctgaggcggtagatcacttgaggtcaggagttcaagaccagcctggccaacatggcgaaaccccgtctctactaaaaatacaaaaattagccgggcgtggtggtgggtgcctgtagttccagctactcgggaggctgaggcatgagaattgcttgaacccgggaggcagaggttgcagtgagccgaggtcatgccactgtactctagcctgggtgacagagggagattccatcttaaaaaaaaaaaaaaagaaagaaagaaaaagaaaacgcagttggctttattctctactagaaggagttacaactctatctttcagaaagcccttactgaagatgaaacaaagaaaaataaagaattggagtccaacacgtgcagcttcaagttgaaagagaaacagttgtgttgggattaaaagccttactttaaaaagtctcttgcccgggtttggattcaaaattctctgcagtatgtttgttctggaacttgttccctttgccttaactgctcctctagatattacagagttgaaaactctgaaggggttggcactgcatgatatcctgacagagatacacttgtttgtgcatagaggtaacttacattatcccccagctgagaagctgtggagaaggtagcctgctttggggttaaggatggttaggacaggaggcttcattcttgaagcaaagaaactaatgaattgtaaatcagacccttcttgttagcagttctgtcttgccactgtttaaaattttgttccagagctgggtacggtggctcaagcctgtaatcctagcactttgggaggccaaagcaggcagatcacctgaggtcaggagttgaagaccagcctgggcaacatggtgaaaccccgtctctactaaaaatacaaaaaattagcctggcatggtggcgcacgcctgtaatcccagctacgtgggaggctgaggtgggagaatcatttgaacct

SEQ ID NO: 8737 - DNA, 1558 bp, Homo sapiens
atgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctgg

SEQ ID NO: 8738 - DNA, 1158 bp, Homo sapiens
ccaaatacctgtctggaccctcggtgtcctccttgtaaatggtgtggtctgggtgcctccatgttgaaacattcgataaaaatggatgatgtccccatctcaagtgctgggctgtgtgtacatcttccctctgcctctccccacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaaggaactgagtccc

SEQ ID NO: 8739 - DNA, 1816 bp, Homo sapiens
gttcaaagatgcttcactttttgataggctaaatagacatctccactcccattttaatgtatagtttatctatattcttttctggatacatgtaaagattgtaatataaaaaatgattagggtttaatatatcaaaccaaacaaaaaatgtcatattcccaaatgacccattctggcttcaccttgtaaactgtccatcaatggagaaccagttaaataaataaatatgatatgaccatataataaaataaccacttaaggaatgaggtaatctatgtgcaatgcaatatgaaaagatgttaaaaatgttttggtcaaaaacaagctataaagtagaatccaatttttgcaaaatagtaataatgtgagtatacgtgtagaaaaaattataaaagaattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccagccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggatccagctgtggctacaacatagggtttttatacaagaaaaataaagtgaattaagcgtgaaaaaaaaattataaaagaatttataccagaatatatatcagtgataatccctggagcagtgctatctgatagaactttctttgatgatgggacagttctatttctagattgtccaaaagagtaacatgtgaaatgtggctagtgtgactgagaaaataaattttaaattttaatagttaacgtgcctacttgctattgtattgaacagtacagcagaaagtaagattaatcctaagggggactttggttttcaggattacttatattttataataagactgtattacatatatacatgcctacatttatgtatgtatatatgtgtattttttatctatagaggttgccttgtctcataattatgtctacttgtcttctccatactccaaatgtaacagttcattgaaagtacatatgaaaaccattaataattcaagtaatagtcttttcctctcaacttactcaagatatac

SEQ ID NO: 8740 - DNA, 1954 bp, Homo sapiens
agcaaggaaaatacttccaaatttgaaagtttgtgtttatgaatagatgtctcttgagtgttgataacacagtaatcaaaccaaatttaaaagcatctttaagatcaaggcagaaatggaacccaagattgctgtgctttccattttcgtaatcacaggtgtgagagagatggctgagaaacgagttcaaggctgatgcctgttcccagcggcatgcctttagatggcccgaggtcaggggtgcttatgaagccctcacaagttgagacagtttattccagcaagaggctaccagccttctgcttgcatctcactcgtgcagatattttgatggtgtaggagatttgctcttctgtatttaacttttcatcttgttccctttcctctcccctgcagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatag

SEQ ID NO: 8741 - DNA, 1241 bp, Homo sapiens
ttaagcaatattaacaacaataaatgaataaaatcgtgtgtttctcctaggcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttagccttgtgtggttcttttaatgaggaactaaatgtaataccacctagatatacaacatcagttagcaatgctgtggcttaaagtaatgttgcgcggagccgcgatgcctaaaggagggagaaagggaggccacaaaggctggg

SEQ ID NO: 8742 - DNA, 1189 bp, Homo sapiens
ttccagcaacatttttagagggggatggccccggtggccctcccctcaattccacaccccagacccaacctaccagtctctgttcttcaatgatccagcctgactctacctacttcctcttcagattccttcaccctatttaccttcctcaagtactggagaataaaattgaactgaatgtttgatgtctgtctgggaaagagctggggccatggaattcaggtgtggtatttagatcctaataacaatagttactatttattgagtttctattatgcaatagatccagtgctgagtgctttacctagataatgttatttcaatctcatgataacttggttaagtaggcactgatattaacttaatttcacaccgattaagctacagcatatttatcaatattatatatatattgctttggatggatggttgggtgggtgggtgggtggacggatgggcagatgggtggatgggtgggtgggtagatgtatgtatggatggatggatggatggatggatggatggatggtttgcatagttgcatggttggatggttgcatggttggatgaatggatggatggatgaatgaatggatggtggatggatggatggatggatggatagatggatggatgaatgatggatggatgaatggacagatggcacattccccaacaaggcaatggtatgcaaaaaaattttagccttgaatcctcgtatattttctgtgggtcttagttatagaaagaagcttatcttcctgtcatctcaaaatgtgtgtagactctcataacctcttctctcatattggtcttatgctcacctacattctcactaagttataggaactgtaggcattttaactcccttagtgatggccacactgaattaaaaattggacaactggacttgatttgctcttgtgcctggattatcagagcatttatgtagactaggcttgaatctctccctctggcaatctaaaagtaggaaggagagttaaatttgaattattctttagtctaagcaatcttacactcatccattcacctattcagtcatttattcatttaatgaatatttattaagagcccaatatgcaccaaccaagttctaggtgttaaggatacagcaatgaacaaggcagacaaggtctctgttctcatggagtttgccattttttaaaat

SEQ ID NO: 8743 - DNA, 1150 bp, Homo sapiens
tttgctttctaagactatggccatctccaataataaggtcctagtgatagtgtcatgggcatttttagcttaattagtggatggtgataccagtctattcttaatttgcattttctttccacattatattatttccgtcaatttgatctcattcgaagtcatccgtttcatgcagtgattacttttgattgcttttgccatattttttagatgtgtcctgagttagagagaaactgagtctttttcttccactgctcgtgtttagagttaagtggctgggcataggagcttggacatggctctcacggtcaggtgggcaaactcatgagcggcacgttgattgccagtgtcacgtgggttcagaaatccatagccctagaagcaatttcttatttgaaatgaatgtgcttggcgtgtaactggattcctttcctcttttaggtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagtaaggagggttaacaaggtcgtgagatccctggaggacttttagaaggattttaggagtgcttggtgcgttctcccaagggttccaacactgaacctcatacagtaattgggctctttttaaaatcatgtcttttttccaagcctttagggttttaaaaatgtattttaaaagtgtgtagttcttattaattttgattttaaaaaatagggccagtgtggcagctcttccctgtcatcccagtactttgggaggccgaggcagaaggatcacttgagcccaggagttcaggatcagtctgggcaatatagtgagaccccatctcttaaaaaaaataaaaataaaaaagataaaaattagctgggcttggtggtgcatgccagtagttccagcttttcaggatgctgaggcgggaggaacgcttgaacccaggaggtcgaggctgcagtgaactgtgatcatgccactgtactccagcctgggtgacagagctggaccctgtctcgaaaaa

SEQ ID NO: 8744 - DNA, 1209 bp, Homo sapiens
agtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaag

SEQ ID NO: 8745 - DNA, 1063 bp, Homo sapiens
tgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaattttcttccagggtctgtttgctctccctccagagatgtgctgagtggccgtggcttcttcccacccaccgtgtcctgctcttccctgttcttggcctaagtcttgcacaggagcctgtcgaggcccttgggacacttccagaagccaggtccattttctccatgaacaggtgggccagggttgagtctccccctagttggactgggagcacatgtggtaagatgccaggggaagctccgtgtttatcctccacatgcctggaaggatgcagtggaagcctttgcctggcgtggtttctttctggcttgaagtttctgccaagctttagggccctgctggcctgggaagcagcgttggcaggcctgccttgcggatggcacgctgcagcactggcagggggcagtgccaggcgggaggggcaggggaggatgcccttcctggccaaatcccttggttaagt

SEQ ID NO: 8746 - DNA, 1126 bp, Homo sapiens
ttgtaggagtccctgagcaattgcagagggccttgaaggaaccagtcggagaggggacttacttgccctccctgttccgtgggcagtgaggtttgcatgctaggtgcccctgccaagcactccttgccagcagaatggggaggtcagggtccacagtggaacaggcctggagaaagcaggagtcgggcctcacctgagccgcctcctgtgttgttgcaggacttggctccgtacctgcccagcgtgacgcctggcctgaaagcatcgcttttggaccctgtgcctgaggtgagtctgaggtaggctgggggatgggccaggcccctcatccagtccccataaatggattcctgagaattccccaaagctgcttttgtgtctgttgggtaaagagaaagaggccctcggtgccccttcctgctcccatgtggctaccttgttttgagcctcatcttctcacaccatctctgctctcggttacctgacaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacagggtaaggccagagcaggtccagtggccagcctgggaatgctctaaggggccctcagatccagtggactcattctgtcctttgttgcagggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagtaggtaccatgaccttggcaagggtagagtccttgaggagggcaggaggcaagtgctcacctggagagctagagatccctgctggctggggttggttggcagagccctcagccttcagtgagccccatgttttttgggctgggggcctgggggtggcagctctggctgacccaccctctgtgtgcccaggctcttgctgatgagaatgagtttg

SEQ ID NO: 8747 - DNA, 1095 bp, Homo sapiens
caccctagtagctggggttacaggtgcccaccaccatacccagctaatttttgtatttttagtagagacagggtttcaccatgttggccaagatggtctctatttcctgacctcgtgatctgcctgcctcagcctcccaaagtgttgggattatgggtgtgagccaccgcgcccggccaaggtttggcttttttaactgttagtgccaagaagtgaaggtggctcccctgtgctgtcctccctttcgctcagccacattcctttgctggggcttcttgagctgaggcagagggtgctgcctcctcatggggcatctactagttccacagctgtttctgagtgtttccagaggggtgggaggtggcagggaggttgctgtcccttctgttctctgtggctacccccaggggacattctcttcccagccgtcccaccttcttttcccctaggagccctctttgccttcgagatgctctgcaccatgctggggaaactttttgagccgtatgtggttcacgtgctgccccatctgctcctgtgctttggggatggaaaccagtatgtgcgtgaggtaagtccccggactgctcgggagaacagcatggaaactttatgagatgtgttcccagctgtgtctgcaggccttggcacagggtctgacataatagaaccccagtaagcgttggttataggaggaacgctaggactggtgtcaggccttgccccttgcttgggtgaggaggcccctgaatgtgttttctccccccttgaggctgcagatgactgtgccaaggctgtgatgagcaacttgagtgctcacggggtgaagctggtgctcccctccttactggctgccctggaggaggaatcgtggcggaccaaagctggtaagaccactcgctctgcctctcttcccagcttcctgttatgaaaaccagcctcagcaaggatcctgggtagccacagctcttgtcctgtgagctccccagaccagggatagggttaagactctgcctttttaaaaatttgagatggagtcttgctctatcacccaggctggtctttacctttggggctcaaaccattctcacagga

SEQ ID NO: 8748 - DNA, 1111 bp, Homo sapiens
aagctttctttctgagtggatttagtctttagagtcccttccttggtcccctgccccactgcccaggcctaggttttccatttagaccagaaatggcaccatatgggccaaagcttttgtcgtcagcagattgtagtgtgcaccctcagaggtatacaacactgtgtatacctgtttgcttctctggtgccctgtgacatccgcaggcagtggctgagatggggcttgggacatctagtggtgggtgctgtgtagaatggtcagaccccccaccaaccatgaaacggctgcagcggagccacagcattgacaggtgggcccttccccaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggtgagcatctctgagcttggggctgcccagcatgggaagttggtccccaggttgccagaggaaggaatctgaccgtggcgccccaggtggaggccgttgcttgtgcgtgtactacagagggccccgctgtgtgcgacccagtccagctgcgtccttgctgctttccttggacttgcaaatttttttttcttttctgttttttttttttgagacggagtctcgctctgtcgcccaggctagagtgcagtggcgtgatcttggctcactgcaagctcagcctcctgggttcatgccattctcctgccttagcctcccaagtagctgggaccacaggcgcccgccaccacgcccggctaattttttgtatttttagtagaggcggggtttcaccgtgttagccaggatggtctcgatctcctgacctcgtgatctgtccgcctcagcctcccaaagtgctgggattacaggcatgaaccaccgcgcccggccacaaatttctaactcagcaacacccttagctgagagaggtttggct

SEQ ID NO: 8749 - DNA, 1154 bp, Homo sapiens
ctcctggaccagttcctggtgccttctttacccctgcaggctttttagatgcaaagccacaggtgcttccttcttccaggcacatctcacagcctgtgggtcccattgcaggaagctgggcatccatttctactccagcaaggaccccagggaagaactgagtgaggggccgctgtgtccgtagcatatttggttcctgtgttccaagcctgcacagggctcttagcagtattatctcatgtgtctccacacaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtgggtgtgggagagcccagagctttaggggatggggtaagagcaggccaggcagaaggcctcaaagagctcccttccccttcagttgccgtgcagtctggactttggccagcacttcttgccaggatgaagatcgatcctgaagcctttatcaccaggcacctggatcagatcattcccaggatgaccacacagagtcccctaaaccaggtgacgggcacatgagctggtctggcctcaggtccgggagggggccctctcatcacagtgtacaggaagagaggattcaaagaagcaggtgaagatggatgaaatgtaggcttggacccttggttgcacgtgacagaaatgtaaactggtttaagcacaaaagggaacttactgcctcatttacctgcaaagtccaaggatatgactggctacaggggttcacatgttgcccttggaacattgtaggtgatgtctctcttactctgtcccatccatctttgtctgttgtctctgttttccacgatgtgggctccattctcaggctttccctttctggtagcacaagagctgctagagttccaggctttgtcttgccatcagctcctaggggaatagcttgcatatttcaataatgtctactggcttggggtcgctttgaccctgattaatctgacttgggtgccatgctcatctctgcacccatcct

SEQ ID NO: 8750 - DNA, 1764 bp, Homo sapiens
gtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaattttgtaattttttttcctttttgacacagggtctggctgttgcccaggctggagtgtggtggtgtaatcataactcactgcacccttgaactcctgggatcaagggatcctcgtatctcagcctcccaagtagctgggactacaggcacacaccatgacactcagctactaatttttaaattttttttttgtagagatattgcacaagctggtctcaaattcctggcctcaaggaatcctgcctcagcctcccaaagtgctaggattacaggcttgagccaccatgtgcctggcccttaattttgaggtttatagtgccatatgctagaaacgaaagccatggtaaaaccagagctttgtatttaggtgttgatgtttgggtatctaaatgaagctaccaatcaaacatcctatacagttttctagacacagttgtaactattacactagaattactgtttctatggctgctgcatacttggagtag

SEQ ID NO: 8751 - DNA, 1946 bp, Homo sapiens
atagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccat

SEQ ID NO: 8752 - DNA, 1213 bp, Homo sapiens
ggttgcagtgagctgagatcgcaccattgcagtccagcctgggtgacaagagggagactctgtctcaaaaaataaaaataaaataaataaataatttttaaaaagtacatttaaaaaaatgtcactactggacgggtgtggtggctagtgcctataatctcagcacttagggaagccaggcgggaggatcacttgagttcaggaaaacagcccatctctacaaaacattaaaaaattatccagttgtagaggtgccaacctgtagtcctaggtactggggatgttgaggaaggaagattgcttgagcccaggagttggaggctgcagtgagccatgatcacaccattacactccagcctgggtgacagagcaagtccttgttccaaaaaagaaagagaggagcgcagcactgccgcctggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaaggggagggaggggaggaagggagggagggaggaaggaaggaaggaaggaaggaaggaaggaaggaaggaaggaaggaaggaaggaaggggaaagttaaatagaaagaaagagacacagacgggccgcgagcggtagctcatgcctgtaat

SEQ ID NO: 8753 - DNA, 1341 bp, Homo sapiens
ttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgttgctgggcttgtgaatg

SEQ ID NO: 8754 - DNA, 1160 bp, Homo sapiens
tgggaattgccgcggattagccatgcgctcctggggtaattaggaccatgtgttcttcctaaaacagggctggggccacagggctgccagaggttgtgttgggaggaggctgatgaggaaaatgtcggcactgagttcagggagactctgtgatggaccttggggggtctcccaggagggccagtgaggtcttagtgttaggctgtgggtctgggtcactggcccgcccccttccctgtgttagtccttagggaaggcattttctggacatagtccctagggagggaggcaggaaggaggcacactcgagccagccagggtgtgggtgcacagctgcccatgacaggcctagaggcgggggtccaagagggagcttgcggggggggggcctttaaagaggctggggccacagagagcttgtcagctggcatcctggcaggggggctcgagcccctgctggtggcggtaggccacaggactcagatgcccactttctcattccctcccctaacagatggtgactcgaacgaagaagatctttgtgggggggctgtcggtgaacaccacggtggaggacgtgaagcaatattttgagcagtttgggaaggtgggtttaaactgggggcgcttgctgctggggctgtgaacacactgtagaatggggcactagcaagccgaatccagccaggtcattccattcctgcaaaagatgagagtggggctggatcctgctgtgggggcagaccaggccaatccaccttgcagcctcctggctcatctgtgagcttcagactcaggatatccctcgggacagagaagccacacagtagctggccctgttgttgcccttccactgtatttttctcttacttatcttcattctcacaagggaggcagtgctcccacagccagttcaatcaagtcagcccgtggcctcctgggagtttgcacctgtccaggccacaggctattgaacctttccccactccttccaggcgaggatgataaggaggcaataaatatgactcccaattgcactcggcaccctatttgcacaggtggggagcttggagccagagctggggggctgctggtcccctgggtattggggggaactgatgagagcatcccccaattcctgatcaggcccagaggattgg

SEQ ID NO: 8755 - DNA, 1140 bp, Homo sapiens
cggcagcgccaactccgctcgcacctgcggctcaaacttttgtgaggctgctcccggagcggcgggaacccggccggagccgtcccccttccagcccagctcggccctcggcttcccggggccccggtgggcgccaggaggctcagcgggaacggggcgagggcggtggggggcggcggcagtggagaacgcgcgggcagcttggcgcgggggcggccgggccgctccggggtcaccgggggcaaaggacgggggggggggaagggcgcggggcccgggctggtccgaaggcgggtgtgtggttacagaagggctgcgcgaatacttcggccagttcggggaggtgaaggagtgtctggtgatgcgggaccccctgaccaagagatccaggtgagcccctcaccccctcctcctgctcccggctcgcccccctccacccgccactcactgccttgtaaccatctgcctctccctcactacggcgcgcaggggtttcggcttcgtcactttcatggaccaggcgggggtggataaagtgctggcgcaatcgcggcacgagctcgactccaaaacagtgagtggccctcggggcttcgggggtcctttgggagagggaggctgccggaggagagggtcaggactctccccaggggacagctggacggggtccatgaggaaggagggagtttttctgagtaagagggctgccatgctctgaaactttgtcactagagttgggggggagagggaggagaaaaatccctggcctgccatgagatgctacatcccccctcccctagtcctggtgaggggagaggcagccgccaccctctccctagaagtactaatcatgatgcctcagagcagagcttggggtggggctaggtccctcccccagcccaaattgggtgagtcagggtagcactgacccacccggtggcttctgtgaactctaactagtatttggctctgcgacaccccctcttcatccagaccaatggcaaagcatcccttgaagccccctccctctctccttccctcctcccccgacttttggtcaatgagctccttgctttgtgtggaagacagggacctgctttgcccacggaggggatttatgagaaaggctctagcttgcct

SEQ ID NO: 8756 - DNA, 1260 bp, Homo sapiens
gtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaaga

SEQ ID NO: 8757 - DNA, 1153 bp, Homo sapiens
cttcattcttgaaatgggatagtaagagtacctacctcataatgttatgaaggtttaatgagatagcctcatgccaggcacagagtacacagtaagtgctcaatacttaactattattgttagatgttggtttgcttattcttctggctctgatttttttcccctttactctttttgtttttgtttgcatttcagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgacatgtgtggttgtccttgattaagttcacagatttcaccaaataggcacactaatttaaaaaatcactgagttgtagtcataacttgtacccagttaggagcaggggtagataactttatttatatggggatagacagttgctctgatgttggtttgagaacgtaaactccaagagcgggttctgggttctcttttaattcaaggccaagcttgtaaattaggctgccttaaagaaaaaagcattgcagataaaggaagggaatgggaaaaataaacacacggtggcttttgcctgtgatcctagccctttgggaggccaaggcatgccagaggatcccttgaggccaggagttcacgaccagataggcaacatagcaaaacccccacctctacttaaaaaaaaattaactggacgtggtgatgcacatatgtagtcccagttacttaggaggctgaggtggg

SEQ ID NO: 8758 - DNA, 1085 bp, Homo sapiens
ttcatgtctggtttcaaaattcccatgtcctgtgaaaccctgtcaagcaataaataattggtactgttaaatttcataatggaaaaaattggaactcaaagtattaggagtttggcattgattttaaaggacaaagaaagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaggatttaagtgatcatggagaaaggaccataggtattgctggctcttaacagggcagttaacatagctgaaggatgtgggctttcttatgttctccatgcctaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgaggtgggtccttgccttctgttgaggagcttgtactcaaatcactccacttgaacctgacctagcagaggtagcaagaggccatgccatttggtaacctcacagtaccataagagatctatcttaggtggacaaagccatggaatttgctatgcctaagtccttcagggtcatagctgaaagaagtatgcattcatggtacgtttgttttttaatatgctttattctgcatattagtatcacattacacagtttggtcatggtatttgtaacctggagagaatactagtgcagtcggtcttcataccaccccattcacaaccagcttaaatggcagtatccctctgtgaactcaactacccctcctgtgggtccaggctgagctctacaggtcagcctcttcatctcagcccttctaggtcctgctgtcagggctgagctgtcacttcacttttttcccagagtagtgcagcatcctctctgaaa

SEQ ID NO: 8759 - DNA, 1153 bp, Homo sapiens
catcttaggaggaagactgcataagaggaaatgctacatacttttttttttttttgagctgaggtcgcgccactgcactccagcctgggtgacagagtgagactctgtctcaaaaaaaaaaaaaaaaaattcctcttcctggccgggcgaggtggctcatgcctgtaatcccagcactttgggaggctgaggtgagtggatcacctgaggtcaagagttggagaccagcatggtcaacatggcgaaaccctgtctctactaaaaatacaaaaatcagctgggtgtggtttaatcccacacgcctgtaatcccagctactcaggaggctgaggcaggagagtcacttgaacctgggaggcagaggttgcagtgagccaagatcgtgccattgcactccagcctggatgacagagtaagactccgtctcaaaaaaaaaagctgtgtaaaaggagggttttttttgggtttctgctataaatcagtgtcatcctaatctgaaatactgattcattctcattctctctaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaagtgagtattgctacccctcagaggaaagggaaagtaggactctccggatagctgtggtgcctctgtgagaggctttttttaagctattgtgggaaagaagcagaaagggaattggtctcgttctttttctgttcaccactgccccgcccttcctttcttttacccactttccaggtggatgtttttggtacttaatataatgcttaaataacttagtatcatgataaggtagaaaacatgtttggaattggacctagatttgaatcttgtttcggcctttgaccttaagtaacttaacagctttgagatttagcctctcctttataaggaagaggaaaggtttttttttttttttttttttttttttttttttttttttttttttttttttttttttttttttgagatgtagtctcgctctgccacc

SEQ ID NO: 8760 - DNA, 1149 bp, Homo sapiens
ctgttgtgtattagttttattatatttaacggttattatggtttccttgatgctttgcttaaagagctatcatacaaagccaggcgcggtggctcacgccggtaattccaggactttgggaggccgaggcgggcggatcacaaggtcaggagatcaagaccatcctggctaacacagtgaaaccccgtctctactaaaaaattagctgagcgtggtggcaggcgcctgtagtcccagctactccagaggctgaggcaggagaatggcgtgaaccaaggagatggaccgtctcaaaaaaaaaaaaaaaagaaaaaaatgatcatacatgtacctacgttgtaaacaattttagaaagatatgttgagtataaggatgtacggggatagagatgagagagatgcggatgagagagtagagaggcctaaaactttgacagtccctaatcagttcttcaagcagtgaaccttctggtggcattttgtttcagcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagaggtgagattgagacatttactcagttagatcccaatctcttcactccttgccctgctacatatgagtgtccatgtttcagtgttgttgccacagagtcacatcagtatgttgttggtgataccattacgatgcagctgatgaagagggagaaaggggtgttggtggctttgcccaaatccaaatggatgaatgtagaccatcccattcatctaggaggtgagttctttaaattttggggacaaataatcctgggtacattctttaaggtgattgaatatatctaagcatcagaaagtgaagcctttgggcagggcacatctggcatgttcatattagtcataggattccagtaggttagggtggggtttgtagagagtagattaattattggtttcaagtttgtttaatctatacatcctaatttttcattttacaaggttttattacatagtgtctttcactgtgcccaatcttag

SEQ ID NO: 8761 - DNA, 1315 bp, Homo sapiens
tcattgccttttaacttttggtcctgttgagaggccattctaagcccttgcccttcaagctaagtgtgtgtctggaaacttaaccttctctggtgttctctctggccacgttagactcgggaagaggctctgtcgggattggccggaagcagaagggaggtcactggtgttgtggctgctctggaacaactggtgctgatggctcccttggcgaaggagtctgtttttcaacccaggaaggttagtgtgttcctgttactaagtggctgccgttcctcaaatgctgtcattgagctggtaggcattactgtgagatctaaaccttctcaagagaagaggggacaatgagtattttctgtatgcttgttattagttctttccccaggggtgttaaatcagtgaacacgacagctaagataaacatctagggagcttggctcttaggtctgcatttgccacattgctttcggaaagcaggagatatcctttctgttgacttagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaaggtgagggtgccggaagagagggctgggttgccgcagaggtgtttcagaggtgacccggtgctctaagcagaggagcgccactagatcctgtggcttgggtggcttgagcccttgggcatggggaggggtggggagcctcctggggactggccaagactggtgtgtgatagagccccttgtcctcagcggaagatggacagcatatgttcctgcaccctgtgaatgtgcgctgcctcgtgcgggagtacggcagcctggagaggagccccgagaagatctcagcaactgtggtggagattgctggctactccatgtctgaggtgaggccttcctgtagaaatggagggtcaggcagcagtattaacctaatctctttgaggtaggcctagccatcctaagttcacaaaccttcaaggcctttagtttttgtatttttagtctttctgtcagtgatggtgctgtgaattctttgtaagtgaagtgtcccctcagcatgccagggttctgttaaatcagttaatg

SEQ ID NO: 8762 - DNA, 1134 bp, Homo sapiens
tcaagtctgcagtgagctggcctgggcggcagagcaagaccatgtctcagaaaaaaaaaattgggcttcattttctactatttcaggccaagtgtctttcaatagggagatctgctttatcttccttcccagttatttattctgtcagtggttcccaggtttttttctgttctgtttttctgccaacaaataactttatcttctctgttcgtccccctcagctgtggggccttgaaaaaatcagaaacagctgatgggctttagattatttgttgctggactcagttcactcctttgcagtacaaaccaaaaataactggatttggttgcttattccaccttgctgtaggttgacagtttctctttggcttttcaaaatgaggataattgagcactactgtttccagccccagtgctggctgtgttatgtatatattgttggatatcggggttaggaccccctgctttcagagttaggcttgcttttgttgagtattggtcctttttccaatgtaggatgttcgacagcgtcacagatatctctctcacttgccactcacctgtgagttcagcatctgtgaactggctttgcaacctcctgtggtctctaaggaaaccctagagatgttctcaggtgagaatgcccctgctctgcttctctttatagtagggttcagggattcttgtggctagacacccagtgggggaggaaacttatggaactgtatcatgagtcttagtacctcctaaacacttcatctgttcatctagtccagctgggcctactgttgtgggtttagctgctaatactgggaggaggtaatgaccatgttgtcctgggtctacctctttacaacctgaccaatctgcagatgacattgagaagaggaaacgtcagcgccaaaagaaggctcgggaggaacgccgccgagagcgcaggattgagatagaggagaacaagaaacagggcaagtgtaagttcaggaactttcatctttgactagcactgctgtacgtcgttgtatagaactctgtgtctgggacctgggagccagaccttagccacttgttttcttcaacttttaaatgtgaatcatgagagcacctccttaataggcttgcttgcaaatataa

SEQ ID NO: 8763 - DNA, 1082 bp, Homo sapiens
tagaaggacagttattgtaaatttgggttttagcttttgtctgcatcctctagacctttgggggtacgcatgtgtgatgtcctcaactgttggaaactatttgaaaaattcaggccaggtgtggtggctcacgtctataatcccaacactttgggaggccaaggtgggcagatcacttgagctcaggagttcaagaccaggctggacaacatggtgaaacctcatctctttaaaaattcaaaaaattagctaggtgtggtggcacgtgcctgtggtcccggctactcgggaggctgaggtgggaggatcgcttgagcctgggaggcagaggatgcagtgaacagagatcgtaccactacactccagcctgggtgacagagtgagaccccatctcaaaaaaaaaaaaaaaaaattgaattctgtaaatgggtttacaagggttatctttcctttgcagacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcaggtaaacaggtgaaatttaatgaattcacccatcagttagaccttatgcaaagctttggtgtctgagtttacaaccccggcccactcagcatggtgtggacttcaggggcataaccttactttggtagtcctgaggtacatcaaattcttttattcatctttcccacttgctatactgactgctttaccctgccagcttctaagcacctcaaggagctctttaggcaggatagttgaaaatggagtcttccctttgacccacctatttttgtttctagtttttgtttgagatactcccctgtatgcctaaacatctttgtacatgtctctttattgtagcatcgttttaatagctcaaaaaaaaaaaacagtttagaaagcctaccaataagaaaatgactaaattatagtatttatactgtaaaatgtttcacaccagaaggccgggcgtggtggcttatgcctgtaat

SEQ ID NO: 8764 - DNA, 1140 bp, Homo sapiens
tttttaggggtcccaggaagggcagaaaaacttaaccagaaagtcggaattcccaatttgagggtctcagtaagaatctcttgtgccttctgtgcagtgttctttacccatttcctaaggaacaaacagcttatggtttactaccttgtgggtttcattgccatttccattagccaggatatagaggacatgactagaacagtgtgttaaggagagaagtacctggaaaatcttttcaaaggtgatagttggttctgtgcctctccagttagtcaaggtaggtctgaaaaagaagttggaccagctacttaaattctctcccccacttctttcccactttggcagatgctgagggttggaaaagcaaaagcagatgtgtggcccaaaactgctccaaagaaaggtgaggatggtccactggtgaagggggagtttggcttctttccataaaaggctgtttctagaaaaagagttgtttctatagttttaacactggtattttttagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctggtaagggcagaggctggagtgcccagggttgtcaaacatactacacatgtactgccattcccgcctggattcagtggcagacatcactaattaggctctttcccttctgaacccttcagcacactctagtgtcatttaaataatactccatttggtatgtcagataggacctatttgccaccccagagaaattgatgacgcctgaaagtgaaattctgaggaactcttccaagatacagtggggtgtacaacctgtatcctttagaatcttgagttggtacagggtggctaattagatggagaagtcagtctcgaagcctgttgcactctgttcatgactagacaagaatcacatatgtatggcgtgctatgtgcctagcactgtgctaattctcccaacaaccacgttaaatgggtgtacctcacgttacagatggggaaactgaggtccagggaggtaaaagtgatttgccca

SEQ ID NO: 8765 - DNA, 1208 bp, Homo sapiens
ttgaagagacaaggtcttgctctgtcacccaggctggagtgcagggtacaatcatagctcactgcagcctcaaactcctgggctcaagtgatcctcctgccctagcctcctgagtatctatgaccaggggcacagctgccatgcctggctaattttaaaatttttaatagagatggggtcttgctatgttgcccaggctggtcttgaactcctggcctcaactgatcctcccacctcagcctcttgaagtgctgggattacaggcataagccgccatacccagctgttcagcccttttaaaatttcctactgaaggctgagccctctgtccctcctgcctatctgcccggctcaagttagcttaagtaagctttaaagcacgtcgaaatccctggatcccttgctatcctcaaacctcaaggtagtatcagctcctgcacctgcccccaaagcaggatgggatttcttcaaagtgtgtgatttttccatagggaccaggttttgccggctcctgtctcctgtttccaacgacagaggcatatcccaaggtcgacaagtgggtgctatgcccggactggcctgcagggggcaggaaccaccagatttgactgagttgatgccctgctgaataaatggatgccacgcttggccctttaataccaatgctgggcaggggaagacggcgctttctagatgcttggcacagtgccaagccctttgcatgtattatctcattagctcctcacaagagccctgtgggaggtgctattagaatccctattttataaatgaagaaactgaagccgagaaagatcaacatgtcctctaggccacatggttactgagcagcagacaagattttttttttttttttaaatagagatgaggtctcactatgttgtccaggctggtctcgaactcctgggctcaatgatcctcctgccttggcctccaaggattacaggtgtgagccaccatgcccggcccaggatatgatttgaatccaagtcagcgtgactcctcagtccaagcctttttttttttttttttttttttttgagatgaagtctcactctgtcgctcagcctggagtgcaatgacgcgatctcgactcactgcaatctccgcctcccgggttcaagggattctcttgcctcagcctctcgagtagcggcgactgcaggcacctgccaccacgcccagctaac

SEQ ID NO: 8766 - DNA, 1496 bp, Homo sapiens
acactggctgcaggttagaattacctgggagtactaagcaacaccaatgcccagtgcccattggagacagaattaagttagaatttctggggaagctccccagttatgccagtctacagccagcattgagaatctctgctttatgctgtgctgttttggcctttacatatatccacccattcatacctggaccttaacctgagcttccctctggggtccctagtgagcactattgtttcaaaggaacctacatatggtctattttctagattttgcctgcaagtctttcctgatcccctagactcagacagattcccctcactcacattcccagagtttttgtgttttcccttcatagcatttatctgaaatgtaatcagataactgtgtcccagctctaatatctcctgcccacctgctagaatgtaagcgtcctgaaatcaggaactgtgtttctcttatcccccaacaacgttcccagagccaagcacggtgcctgacatttctccactggacaagtgatacttctttcttccatttaaataattactgatccagtagctattcggtgtcttacactttctcatgtatgctatataagcaagctaggaaaagccccatttttccagtggcggaaactgaagttcaggaatgggaggcagccacccagtcagaagctggcagcgctgggcatggtgtctcatgtctgtaatcccagcacttcgggaggccaaggcaggtggatcacctgaggtcaggagttcaagagtagcctgttcaacatggtgaaaccccatctctactaaaaatacaaaaattagccaggcatgaagttgtgcgtctgtaatcctagctactcgggaggctgagccaggagaatcgcttcaacccaggaggcagaggttgcagtgagctgagattgcggcactgcactccagcctgggcaacagagcaagacactgtctaaaaaaaaaaaaaaaagaagctggcagagctagactcaaccccagacctccccgtccttcccattcattggagtccactgacccctgcctgggcctgcttccttcatgctgtttccaggagacacgcatcatcaccctcttttctgttctttagtcatcaatacccgccccccaggctcctcctcctccatctccccctccagaggtttggcccaaacaaggctgctgagtaactcccctgattaaaccattgcgtggttgtcagcagcagcaccggggaggtccaggagttatccagggacctccttcccagctccctaggagtgagcaccctctgggcagcgcccccacccatcttcctaacaggagttctgagcagcccccccacacgggagaaaagttcctgggaaaggaggctctccgggctgaaaactgagctagcgtgcaagaatgggcttgggaggagttctgcttccagtctatctctggtgccccctgctggaaaaagctgggtgcaggaaacagggacac

SEQ ID NO: 8767 - DNA, 1554 bp, Homo sapiens
agcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgta

SEQ ID NO: 8768 - DNA, 1100 bp, Homo sapiens
gttgtcagggttgtgtgtggaggtgggcacagtgaggctcagatttctgaatttggagtggaatgtctagaggtgggccactgaccagaggccagggctggctttggtcagctgagagcactgagtaaataggttggtggggtccatgttgggaagaggggtgagcacatttccctggtatcttggctgaagaatccaggctggagatgacagaggaggccatggtggagagttgattgcatccttatgttgaaatggagatcatgttcagctggggggcctctgtggtctccccagctgtcaagggctgcctccctctgttctgacctcatcgttattctggcagagtatactctgaagcgctggcttattttggaggggatgcaaagttttctcccacctaccctgtggggcagactcaaacataattctttgcttttttcttccccctttgcctgacttgcagttcgtctaatgattgaaaatccttacgagacccgctctgacagcttctactttgttgacaacaagctgataatgcacaacaaggctgattatgcctataatggaggccagtaagtgctgcaagagtagataggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaa

SEQ ID NO: 8769 - DNA, 1137 bp, Homo sapiens
tgggtctgtgtgggcagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaaggtgggcccacccagagaggggttcagccggatcctgggctgctgtcatttctgtttctagggccttctctccttggcccgactggacctatttttgctctggggcaagtgggctgtccctgtccctcctcagctgccactgaagcctgcaccttccccagaagccggcagagggtgtcaaggcctgagcttctgagggaggtggggaggggaccgggttggtgttgggtgtgctggtgtgagggtgtggctgaggggcagctctgagaaaaccacccgcctctcctttcagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatggtgagcccggcagtgggggtggcaccttgaggccaggcccgcgccccggctggcgggccactgaccagggcggtccccacagcaaaccctggacatgggccgcatcggcatcgcctcccaggccctgggcattgcccagaccgccctcgattgtgctgtgaactacgctgagaatcgcatggccttcggggcgcccctcaccaagctccaggtcatccaggtaatggtggcagctttaggagctgggcctagaggctggacagcgggcggagagtgtggcctcctgactgctctccgtcctcctccccctcccttctgtcccctggaggggcagctgctgacctgtggtgtggggtggggctattgcagttcaagttggcagacatggccctggccctggagagtgcccggctgctgacctggcgcgctgccatgctgaaggataacaagaagcctttcatcaaggtgcccacaggggtccccgagccatggcccagaatgtggtg

SEQ ID NO: 8770 - DNA, 1843 bp, Homo sapiens
gcaggagaattgcccgagcccaggagtttgagaccagcctggccaatatataggaagacttcatacctggaaaaaaaattttttttttttaaagaatcagacagctgtgtgtgcctcatgtttaaatctgtaacttagaaagtcccttgtttcccagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtg

SEQ ID NO: 8771 - DNA, 1859 bp, Homo sapiens
tccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtgccaagcctgggcctcttggggaggtttgtattggtgattgtttatttaggccgcctgccctgatgtctgtattccttcctcaggctgacagcgaggtcagatgcccaagtcaaggctaatgtattcagcaaatctctaatttagagcatgtcctaggaccttgctactcagtgtggctcccagaccagtagcgccagtgtcacctgtgagtgggttagaaacgcaggtgccggccgggcacggtggctcacacctgcaatcccagcactttgggaggccaaggtgggaggattgcttgagcctaggagtttgagaccagcctggacaacatggcaagaccccatctcttaaaaaaaaaaaaaaaaattaa

SEQ ID NO: 8772 - DNA, 1164 bp, Homo sapiens
atctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtag

SEQ ID NO: 8773 - DNA, 2499 bp, Homo sapiens
tcttgctgtgttgcccaggctggtcttgaactcatggcctcaagtgatcttcctgcctcatgctcccaaagtgttgggattataggcatgagccactgtgcccagctctagtgtaccattttaattctctcttttttttttaaacatactaacaccaaccggaatctcttgtttcttttgctttattcttttgagttattttctggattgttacctttctcccacctagttcaacccctcagaatcaccaagctaaaggatattaatgctggatctttttgtaaagacaagaaccttttcatagtgtgaataaccgccccctgctatatttgtcatagtctgaaatcagattgtcacatgttgtgttttctaggaatgtggttcctgttttaacgtagtacatgtcaggtaaaaggtaagccagagatagccattcaggagagaactgccagaaatgaaacgcttcctggtgaagggcagtgggtttgggtatgtacagtgccatgatgtttctttttcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaaggtaggaagctgtacgaagactgttaggcaatgctattccagaaagcattgaaagtttaggacccagaagaagaaaagacattaaatttgggacagcatttaagttctgagtgttcacaaatatatattaaaatttcatgcagcatttaaagtgctttcacatgcatgcttggcagaaagattgaggacaagtgaatggctattttaaccctatagagccaagtaccaggctagaagtcaggagttaaagacttttttttttttgagacaaagtctcactctgtagctcaggctggagtgcagtggcgtgatctcggctcactgcaacctccgccttccaggttcaagcaattctcctgcctcagcctcctgaatatgtaaaggcgcacaccaccaagactggctaatttttgtatttttagtagggctttctccatgttggtcaggctgatcttgaactcctgaccttgtgatctgcccacctcagcctcccaaagtgctgggattataggtgtgagccactgcgcccggccttttttttttttttttttttttgagatggagtcactctgtcgcccaggctggagtgcagcggcgtgatctcagctcactgcaacctctgcctcccgggttcaagtgactctcctgcctcagcctcccaagtagctgggattacaggtgcctgccaccacacctggctaatttttgtatttttagtagagacaaggtttcaccatgttggccaggctggcgtcgaactcctgacctcaggtgatccacccgcctcggcctcccaaagtgctaggattacaggcatgagccacttcgcccagtcttaaagacctttttgaaaacctcaccctagtggtttgttttttctctctcaaagaatggagaatataaaagaatcttctggtagttgttgaacaaataaaactaaataccacgttttgaaaactatacgtgaagggttgagttaaatgtgtgtgttattttcccctttccgtcagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaacaagttagtgcaagcatctcagattatgttctctctgggcaaaattgccaatatcttgattagaaattgtacacactccatcattatgtaaattcatttagcacctattctcagacaagagctcttcctggaattggtagatctctccagggtggtcagtgcaggtctgtatgaggcttggactttcttctgaggcctccctgccttgttggactgaaccagcgcttgtggttcctgtggctgctcacgaggacttgttggtccctgactggagattaagaaggaaaagattttttcataatttttggaccaatgaccaggagcatttttcagtccctttctagatgttggctttcttatat

SEQ ID NO: 8774 - DNA, 1157 bp, Homo sapiens
gataaaaatagcttttattataatataaagtgggacataatctcccctcagaaaaataatattgagctaaaaaggaacttgtcaaaggatgcttacaagtatgatattatttatataaagtttaaaaacacaggctcatactctatgttgtttagagacaagggtatatgttgtaaaagtataaaaaacctgaatgagaatgataaataccaaattgagtgcctactttgaaaaaagagaaagagacgtagaatttgcaaaggacttcattggtatctaatagtatatgaagcagataaagcaaaatgtgagttgacaaagttgatgattggcacacatgtatctgctattttattctctgtgctttttcacatacttgagatattttaaaaaaattttaaatccccccaaaaaagaatatgtgtgaattattgtaaggatatttgctaagcaatccaaaatactttcatatactcattaagatgaacattcgccattttgtacttaattgtgtttttttttcttactagttatggatgctatgtgatcaaaaaatacagtttgacagagcaatgaatgatggcaaatatcatttggctgattcacttgttacaggaatcacagctctcaatagcatagagggtgtttataggtaagaaaccttgaaaactctaaccccagaataaaataattgttaaatggttttgtttttgttttatatgtgcattaatttattttagcttagaaaaaaactttattttcttaataaataagaaaatacaggtaagcagctgggcatggtgacttacacctgtaactgggcatggtgacttacacctgtaatcccagcactttgggaggctgaggcgggcgcatcacttgaagtcaggagtttgagaccagcctggccaacatggtgaaaccctctctctactaaaagtacaaaaaattagccaggcatggtggtgggtgcctgtaatcccagctacttgggaggctgagggaggagaattgcttgaacccatgaggcggaggttgcagtgagccaagatcgcaccattgcctccagcccaggcaacagagtgagactccatctccaaaaaaaaaaaaagaaaatacagataagcaaaatgaagaaaataagtatctcccagaga

SEQ ID NO: 8775 - DNA, 1119 bp, Homo sapiens
ctgtcgctacctcacccctcacttagacagtctgtttctaggaattcagtaatgaaaggaagtgccttttttaccagtcttgtttttgtatttcagataattttttggcacggtgtgctctgaaacagctgcagacactggccactgcttacattgccagagcagtctgtgccaggatggcatcgggtctgaattcacccgtgaaaactaattaacatactatgactgcagggaacatggggtgggggcggggggatctgggagcgtgtactcccagctgtgccctaaccactacgtgtctcctcgcgctgcacatccaggatgcttttctgcctttcttatcctgagggcaaggttgctggcactgggaggcatctgctcccaagaaagccagagcctgtgaggtgtatgactttacgcctccactcaagatagctgacgggcatggccaaagcgcagccaggtctgctgctgaaaggaaatcctgttccctctccccacccagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcaggtaggcaggtggccgggcccacgtgcttctggagcaatggaggctctaccatttctttcctctaatgcttgaggaaagcactggacacgtgttggacagttctgctcgacactgtggctgaaagagtgaaatcccaccagtggaaggggaccaagggtggagtctgcaaagttggttgaatttgaggtctttttttggcatcaatgaagggaattctaagaggtcagccagtttcatgtaactaaggaaataaataggattctttgacatttaaggtagcagaggtttgtgtgttttaggagagaggagagtataatagaagtatatctgaaatcataataactaatgttggttgtaaatttgttctgtgccagtccctgtgcctattttatgggtactgtctcatagaatccacttcatgggctcaggtttgttgttatccctatttcacagaactaaagactgaggtcctgggagc

SEQ ID NO: 8776 - DNA, 1334 bp, Homo sapiens
gtagcttgtccattgattcacacctgggaaagaaactcatacgtacagaattgattataatgacaaaagtggctccttgaagtaagcgcaggcttaactacaatttttgccatgaatttaagctggcattttttagttgagctttcatccttgaagatgacaccaaaagctaatgacaagataattttgttgctcatgataggcatccttttttgatctcctattacatatgtgcgcagcactgtttgacatctattatttcattgtaatccttacgataattctttatgataggtttgatgcccattttacagatgaggaagctgaggcttagctaagaagctaagtgactggccctaagtcacacagtaagtagcagaggcagtgtttaagtccaggtccatctaatgctaaagccctgctggctctttcccgtgtaccctctgcctctctcccagacccagtttttcaggaacacatctcgtatggctcagggttaaggccaggttataggtactttccttttaaatagtgctgtcactgtgcatgtgctgaaatgtgaaatccaccacatttctgaagagcaaaacaaattctgtcatgtaatctctatcttgggtcgtgggtatatctgtccccttagtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattctttagagagaagcaggagctagcaagctggttctgtgaaaggccatacatacaagatttacctgccttggatagatgttgttcctgcaggggactatgttttagactataaaacattttgtattttgcacagactgaaaacttttttcccatgcatgttccttcttactcctcccaaccactttgtgaggtaatgggtgggtgatctccatgctgggagagtaaaccagggttcacacatctgatctacccgcgatcgcaaacgcagttaacaagtgacagagaaaggactcaaacccacgtcatctgactccaagcaccgggctcctctgctctgtgacaggaaccttcctgtttataggaggcatgatccatggttgctctagttgagtgtcacctgaaccccaaaactattgtgtaaaagaaagttgcttttctgttaactgaggtgttttctgtggaatattttcatcttat

SEQ ID NO: 8777 - DNA, 1424 bp, Homo sapiens
gtggggtcagattggcaattttactatagtttgatagtgccacagggggggtaagtgcagagggcttatgggagcatggaggggcttataggatctcaccttcatctagaaggtgacagaagcaggtggcccagaggatgagctaggcatgggcgtcggtttgctcagctttgggtagtatatggctggggagcgatgggtgggaggcttggtgtttctggaagaggaaacagtgttgtagatggtcaagaggagagcatgtggcagggtccaccttcagtgttacctagagtgagggaaggccagccaaggctggcgagatgaggggccagagcctgaagggacccctgtagaaaagaaaataatcaggtgatgctagttagtatatcttttcatatgtttattgaccctttctttctactgagttaccatttttaaatttcaggcttctttgctaaagaatgatgagactaaggccctcactccagcttccttgcagaaggaattaaacaatttgttgaaatttaatcctgattttgctgaagcggtaagtctttcccagaatttgttgctgtgttggaaaggaatgacaaggcaactttttttgtttgtttgtttttggaaacagagtcttactctgttgccaggctggagtgcagtggcacgaccttggctcactgcaacctccgactccctggttcaagtgattctcctgcctcagcctcccaggtagctgggattacaggcacgtgccaccacgcccagctaatttttgtatttttagtagagatggggtttcaccatgttggccaggatggtcttgatctcctgacctcatgatctgcccgcgtcggcctcccaaagtgttgggattacaggcgtgagccactgcgcctggccaaggctactttttatattgagtagctgtgcaaatgagaatcagcccattggcccaggttcttgaaggaaatcgtgttcttggtaggcaaacaactcggtataggttgcaaagctcctccctccctcctcgggccataggcgatttcttcttactcttgatgttctctttcagtcatcatcctcctgatgttgtaaagtttggactggagataatatactagactgatgcaaaaaacagtgtttgtttgtttgttttggagactgagtttcgctcttgttgcccaggctggcgtgcagtggtgcgatcttggctcactgcaacctctgcctcccgggttctcagtgattctcctgcctcagcctctcgagtagctgggagtacaggcacacgccacaatgctcagctaattttttgtatttttagtagagacggggtttcaccatgttggccaggctggtctcgaactcctgacctcaggtgatccaccctcctcggcctcccaaagtgctgggattacaggcat

SEQ ID NO: 8778 - DNA, 2280 bp, Homo sapiens
gtgatcttcccacctcagactcccaagtagctgggactacaagcatacaccaccaaacctggctaattttttgtatttttagtagagatgggattttgctttgttgcctaggctggtcttgaactcctgggctcaagcaatccctccgcttccacctcgcaaagtgctgggattacaagtgtgagcaaccgcacctggctgaaaaatgggtaacattaagcatactgttttatagcttttttccccaaattttattattccttatggatccatcttactctttttagtcattgcagataattgaatgtttattggttgatgtgatagtttgacaaattttatgatcaagaaaacaacaatgatacttttcagaaatacgggagtaacattttgaattatgaagtttgttttatgagccaccattttatacaaatctctgaattgcctgtaaaatacattatttgaggtaattgaggaatatgaaacatgagaaattattcaaagggcctttctaaaatatgcacctcgattttctcattcagaatcaaactgatggctgaaggcgagttgaaggatatggaacagttttttgatgacctttcagattctttctctggaactgaaccagaggttcacaaaacaagtgtagtaggtatgaaactcttctaagaagagcagagagtattttcattgaagtgagcagctttctaagtcatgtctatcattgttctgctatatctgtgaacagacacagtggggatgttggaggtgttgcagtttgtatttattgccttactgttttgatctatatttaaatcattaactgtggaaaagcaccttctgttttgtctacaatagtaagagtcagagcctggtcctggggtttttaggggttcccagctctttctcacagtcctctggatcacttgcctgcatggtccatctgtaagtgagggtcaccagcccagacttatgaagagaggtaagtaaaaatacattattgatatagtatgcaaagtgagggcatacgtggtgtttctttgatgcttttctattagctttatcccatgctctatccctctggcttttttgcatggtaatttttatgttattcagcgtgagctatttctctctctcttcctatgtgccaggctctggacgtgtaagatagacatggaatttcctcttatggagattacctctggttgggggagccagttggtaaaagtaaacacataaatatcatttcagatagtgtaacagccatgaagaaagtaaaatggaagccttcaggtggaggtggggtgggtagattgtgccctgtataagaagaaaccagctttgtaaaggactggggaagaacattccaggaggagggaatggcaactgcaagtgtctctttcttactcttctgaaggaagaattccagcagacagtcattgccattgtggagttgccattgcgtagcctggatgtcagttaatgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatgtgttctttgttttctgctgggtccctgactggtattgttcatcacatcagagtgaagtaacacttgattaattcagtgaaaa

SEQ ID NO: 8779 - DNA, 1130 bp, Homo sapiens
gggttgtaacaaatagttaattatagtaagaaaaaccaaattgaataattttctaactcacttggcagtggtggtctcgcagccataatgaacatcacataatgaagttactcctttccagatctataaacaggctcatgtaactaactgatactcagtaaaatggtacacagctttctcaaaaataaatttgacttaattgtgacaaaaacaacccagtttttaaaagcctaaggaaaaatactacagggaaaaaatgaaaagataaacctacaggacttttggttttcttcattctctttgtataaccggtttactttctctaccagttcccatttttcacaacagccagaatagttgacaaaattccgagccagaatttccttcagctggcgcacgctcattccttccacatcatcaaggcttgacaagtcagacagtgaagctctcactctctccttggagagcccggggttctgaaaccacagagcatccattagccctggtcccataagtccagaccctccccactctaaactcatcactggccctgaatattctcccagccatctcagcagtcctagaagtgtttcagtatactgtcctacattcaaaccagaagaaacatcctgtactaatctagcgaatgtccacagggcactgtcccttcctgtcaggctgacatgtcagggaaaccaaattttataggtggcctcacccgatcctctgcgttttcttcttcatcatcatcatcctcatcatcgtcgtcatcatcatcttctgtgtttgctgaagtgatttcactttgtacctacacttatacaacgtatctgattaggtcaggaatcaatctgtatttatcactagagaaaaccttgtcattgatgctccccatgatgaccagaaagccagcataatgcacatctttggattcagaatgctgctgacccttccaaaaagttgggccctacaaaattgcatgaagaacctaccttccataaagttagctcaaaacacaaattcctgtgtgtgtgtaaagttataaaatctaaccagagtattaactctctcaggaaggtcccataatggaatgccaaagccattaaggatatgggacagcactgtgtcat

SEQ ID NO: 8780 - DNA, 1192 bp, Homo sapiens
ttctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgagg

SEQ ID NO: 8781 - DNA, 1196 bp, Homo sapiens
tcaccgcaacctccgcctccagggttcaagcgattctcctgcctcagcctccgagtagctgggattacaggcatgtgccaccacgcccggataattttgtatttttagtagagacagggtttctccatgttggtcaggctggtctcaaactgacctcaggtgatccgcccacctcggcctcccaaagtgctgggattacaggcatgagccaccgcgcctggccggacaataatgttttgagctgttgctgagtctggcttttgtgacgggaacttttagcactcaaggagtggccttgtctctggcctgtccccgagtgctcatgggcagccaaggcctggggactgctcaggcagggtagatgtatttgccaggccagctcccgtccctgggacctcagggagtagcttcatccctgaaggctgagtgtcttctgcctcatgtgggtggcccctctgcagggttctcaggcatccagggaagtgggtgccacagcgttgcctccagcctcactggggctggctggactttgctctgacaacacagcagtggctgggcccctgcaactctccagggctcagtttccctgttggccgcactatggcataggcccctgtgtggacaccgatgagctgaccccacaaatgccacccggccgctcccccaggcttcagtggcctaacagctgttgtgtcaggaaccagcttaaagaatctttcttgctttctcaaactctccaggaattcctggtgactggaagggggagtgactcaggccctcaacctctagcaggtaagggagctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagc

SEQ ID NO: 8782 - DNA, 1150 bp, Homo sapiens
gacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggca

SEQ ID NO: 8783 - DNA, 1104 bp, Homo sapiens
tcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaagg

SEQ ID NO: 8784 - DNA, 1098 bp, Homo sapiens
ctcatcctcctgagtagctgagattacaggcatgtgccaccacacctggctaattttgtatcttcagtagagatggggtttcaccacattggccaggctggtctcgaactcctgacctctggtgatccacctgcctcggcctcccaaggtgctgggattacagatgtgagccattgcacccagcctctctatcttttttttaaagttagtcacaacctacagtgtgaaaacatggtcctggccatctctttcctgggtctataacatgtctccttcaagaagtcacacaaatggttttaggtgccttggtggctttgtcttcctgtcccctggggttgagaacaagctgtctcactggcagagaggcagcctctgcagggtgggccaggccctgtggcccagggctgcacctgaacatcctccttatcctggcagctgccttttcaggccaaccacaagcggtgatcatgacgtcagggcctctgaagagagaagggatgttggcctccaccgtgtcccagtccaacgtggtcattgcgcctgctgccatcgccagggtgaggagggccctaggcagacctgcagtgtccttctcaccccggagcactctgatcttgggcggccctcacctgagacgactggtgtgccgccctgctgtatatcagcagtcaggggtgacctgtctcccatgtcactgcaggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtgagtgttcactcggcgggatggttggggcatcgcaagggaagtaactgggcctgccgtagaccatggggggtgcttgctgggtccccaggacggagcctgggcttaggacacacagtgaggtcttgtaggcctgctgataacacagtctgggaacacgctctgtgggtggcaggatgaaatgtggtggcactggcagggcaaaaagtagtgaacatgt

SEQ ID NO: 8785 - DNA, 1108 bp, Homo sapiens
ggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatattt

SEQ ID NO: 8786 - DNA, 2047 bp, Homo sapiens
aaaaaaaaaaaaaaaatttagccgtgtgtagcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccatttcccgcccatgggccctgaccacactcccttttctagaagtcaatcctaaggtttctctgctctggctaagaggatgtaaatttggattcttagagggcatggcacccccagtccctgcccagataaagtagcacagtggcaggcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtg

SEQ ID NO: 8787 - DNA, 1237 bp, Homo sapiens
gaaagaatgaagagtggcagagataataattgaaagattagtttctcatggaattaatttggccttgatattcagtatttggaaatgtcttaaagaaaaccattttcattgtagaaaatccttttttaaatacttgttatatcccagggagattagtttataccttccacctcaggcagtcatcagctgctttagagaatggaatccaccctgcccctccattttttggttcctggggctcaattcaagtctggtcaagtctccctggctggggattctgtcctgggaacagatactcagttgtagtctcatgtgtctgcactcacccaagactctatatacttgcttgctcagagcatagttagggcagctcctaaaaatgcattcagcagaagactgaaaaacttcaattgcttcatttgtatgcaaatagaaaatggtagataattatatattatacgcctttgtgtaagttcatttaatacttgaagcagtctttgtctcaaaagagtatgcccttactgagaaaggatatgtgaacggtacatttattgttggggagagtggattgtttacatcatgtctggacttttgtctagttgggtagacagttctacaccagcagcccccttaataaagaagtctacacagacactgttttgtgtcttgctatagagtgttgaattctaaccaacagagaattaagtattttgttaattgtggagcaaaagagtaatggttgaaagagggatgatttaaaacagcacatttaattctcagagaaaactgggacagtctcattgtgagttctattcgattcagatctgccctcactgcaaatggattatgattaagcatgatgtgttggtcggtcttgttctcagttgtacactaaagaccagcctgtcaccaggaggaagtgtttgtattgagcagagtttaattcaagaagaaattatttttttgagatgaggtcttattctgttgcccaggctggagtgcagtggcacaatcatagctcaccacagccttgaacttctgggctcaagcagtcctcctgcctcagtctcacgagtagctgggactatagcaaagcaccaccacacccagcaatttttttttcttccttttagagacagggtctttgttgctcaaactcctggcctcaagagaaataattctttttttctttttcattaaatttattatctttttaattttctgttggctagggtgg

SEQ ID NO: 8788 - DNA, 1184 bp, Homo sapiens
acagttttctcccagaagccccggctctgcccaggagaggtgcttccacggctgcacccaccctggggctgccagcctcagcgcctggtctgacaggcagcagttttggaaaatgaacttgagtccccaattttcctggcacagtgtgaaataactggaaatgattttattgtctgtcgctgcaccccagccccaggaacagagatgggcccctgggaggcccccatggcctggcaataattggccttttccctcacaggagtgctacctggagggtgaccagacgagcctgtaccacgcagccaaggggctgatgaccctgcaagctctgtatggaacgatcccccagatctttgggaaaggagaatgcgctcgggtgagaaccggctgctttgtggtggtaaaggagggcccttcacaccccaaaagggaggaggaacgggaagctccttacaaacaaattcagttgatcttaattatttatgaatactgtactcatgaatttgcctactgattaaaatgcacttataaccctccaagtcagtactcatggtgcttttgtcggcgtgcacagtggtgacagtttgagtaaccactgcgcatgttcccaactgaggcagctgacactccaccttcccatttcagctctcagactgcaaacaagtgtacttttcacagtctcactgtcatattttccacacgtgtgtactttttttggtgatttcactgtttaaaatggcctgcaaatgtaggactgaggtgcagtcgggtgtcttgtgcacaagaaggctgtggtgtgcctggcggagacattacgtgtgtcagagacgcttcgttcaggcacgagtcacagagctgctggctgtcagttcagtgtgagtgatcaacaattatgttaagtcaggcatctttaagcagaaacacatataaaactgggttacgtattgatcaattgacagaaacgttgagaccagaggctcccaggaacctaagtctgcgtttctcctaggaacagtggttccatcttcgctaatttagtgtttgcagtgacttcatagaacataactactgcgaatcacaagaatagactgacctgattttatgcctcattggcaaatggcagctgccttggtgcaagtgtcgggatgggtgccaacagcaaggtgcttttctagagctgctta

SEQ ID NO: 8789 - DNA, 1181 bp, Homo sapiens
aatctgtttacttgatctaaaaaaaagtatttttatttaatttctgaaatatttctgagttgcatgaaaccattcttttcaaatgtgtcatgatgtagcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattaggtactaatggcattttaccatagaaggtcatttttatttccctagcatttggaatgttctgtgtctctttgggctaattatcaggatataagtgtactctggcaaagccctaggtaatatacattaattcatttagaaacacttctttaaattttaatttatatttgttagacgtcatggtatgtaatataagcaagaaatgttttaaaataccagaatactatgtgttttcatgcaaataagaattcagtatttttcttcctcctttatttttacttagtgaggaacttcaagatgcactaggtgtgacagacaagagtcttccaccttttatctatcggatgcgccagctagggtacccaccagggtggctcaaagaggctgaattggagaattcggggcttgcactctatgatggaaaaggtatagtatcttaagttagagaagtcaccttaagtgtttcctttttttttttaattaaagaatcacaacaaaatgtgataggaatggccggcttctttaatgtgtgctaactaaaaaatatcatgatgatgtttccttggtaaattttacaaggaaggaataaaatttcagtgagtttgtagattatctgatggttttctgggcttgctcaggtactgtctaggccagagtatcacctctccagccagtcctcataagctcttatctttgtcagtaataataacagacataaatcctaaatgccaggagacctgtaaaatgtaaaatacagaaaacctctaatagtctagaacttctctcctagatacctaccctagaaagatattcacacatatgaaaaggaaattgtatgtatacaagaatctttttgtatcattgaatatgatagtgaaaaatctacgacaacattaaggccctaaaaaagaatggttaaataaattggtagttctgagctgtg

SEQ ID NO: 8790 - DNA, 1792 bp, Homo sapiens
gttaatgaaactactttagacaattattagtgagttttaatttttatgtcagtgtacttagactgacatatgggtcattttaccctaccactctttgaaacaagccagaatagcttgatggttgttcacatacagaacagttcttgacatgttacagttgttactcttcattttgggaggttttacattttagtaatcacctaacagaaatagaggcaggaataaaggaaaatgggacctagtaattatgtagttctgcctttctgtgaatatgttagttttttatttagatatatgaaatattgaaataaaatcctgagacatcttattttctcttttgtaggtgcaaagaagttccagctgatagacaatctactttttgttcttgatactgatgtatgtttcttgtttctccttcaatgtttttacttgatatgttttacaacaaaaatgtcagacttacaaaggcaagggttttagctagggtggataactatcttgtgtactgtgctttttttcagtatatgtaccaaaaagttgatcctgaaatgtaatttttttttttttttttgagatagagtttcgctcttgtttcccaggctggagtgcaatggtgcgatctcggctcactgcaacctccacctcccgggttcaagcgattctcctgcctcagcctcctgagtagctgggattacaggcgcccatcaccacgcccggctaattttttgtatttttagtagagacggggtttcaccatgttggccaggctggtctcgaactcctgaccccaggtggtccacccaccttggcctcccaaagtgctgggattacaggtgtgagccactgcgcctggtctgaaatgtaaatttttaatcattaagaagacacgtaggctaggcgtggtggctagcctactaaaaatacaaaaaatacaaaaatacaaaaaattagctgggcgtggtggtgggcgcctgtaatcccagctactcaggaatctgaggcaggagaatcgcttgaacctgggaggtggaggttgcagtgagccgagatcgcaccattgcactccagcctgggcgacaagagcaaaactctgtctcaaaaaaaaaggacatgtaaatgaaatgtctctattgcagaacgtgctgagtttatgggatatttacactctaactcctgtatggaactggccctctcttcacgtagaagagtttcttcttactacagaagcagactctccttcatcagtcacgtggtatgttatgactatggctagtagtcatttcccttctgttagtaccaggtatcttgtctggttttgttcaggtcatttattatgttttacattctaaacaacactgtgaaacagtctgacagagtaaagaccgtttgcaaaattcactgggaacagttaggcaatatgaacttccaagtcattttgttagaaactgtcagtctgggcataaacgtgcagaaatggaatacagtgtctattacattttattttttatggaagagtgttactttagtttatatcttgtaattggcaaagcctacttttttaatcaatagataatattgtatgtttttgttgtgtaaaagtttacttgaattatttaaaggttcttttctcttttaggcaaggaattacaaatctcaaattaatagctctgacagcttcagctaataagaaggtattggaaaattttattttgtgcttgcctatattatgtgttagaaaaagcattagtgaatacaaaagtagatgttaaatagtacagcatattagctctta

SEQ ID NO: 8791 - DNA, 1127 bp, Homo sapiens
ctgtgggactgaatcttccttccatgatacatgatctagcaagccaagctgccaccatttgcagtccaggtgacaatatttataatatacgtagttttatattctctggttcatgtcatacttgtctcccaaatgctgtctctttacaattggacatcacggtaatcagactagagatagtatctgcatttcacaaagggatgcttataattgattctctttgaggattattgtttgaaagtatttcaaaatactaacaatgtcatttctgactgttgacattactcacttttgtaggattatgaaattccttgcctcccatatctgatcttattttcaagtcaagcttgagaaaaaatttaactttttagggtagtcaaagctatatggaacctttctatctacattgtggccttccttagaattttaaatggtaattattaaaaggttgttttcattatcctaaagacatgaaatatgagtttaatgatttttctccattttgtttcagattttttactagatgctttagaactatgtaaacatactttaatggctgtagagctttccagacaatgccaaatggatgactgtggaatcctcatgaaagtaagttacttttgagttttttcccttaaatcctgggcaacgcattatgcaccttttttttttttcggacagggttttgttctgtcacccaggctggagtgcagtggcatgatcaaggcttactgcagtcttgaactgggcttaagcagtcctcccacctcagccttctgagtagctgggactataagtgtgtgccaccacatctgactaattaaaaaaaaattttttttttgcagagacagggtctcaccatcttgtctaggctggtcttcaattcctgggctcaagtgattcccccacctcagcctctcaaagtgctcggattacaggcatgagccactgcacctgggccgttttttaatcatttgcaaagtttatgaaaatactgaatccacctcttatgttttcttaccctagaccggaaaacaacgtaagggcatgaggccacttctctgttccagtcacttgattggctttaatttgcactatctttcaaaacattgggcctccagcaaggc

SEQ ID NO: 8792 - DNA, 1215 bp, Homo sapiens
aagaaaatatatcaattcaaaagattatacaaagtgtcctaatataaaatataaacataggaaagataagagcgtagagaatttagatctgtagcctctatatttaaaatgaaatcaagtattttgaattatatctcaaattatttgaagagcagataactgtcaagctcttatttacaaaacatctaccaacaacagggcaccagtggtttctcctcataggattcctttaatcattgtatataaattatagtttagatgaataatgttaaagagaatactagaaaaggttttgatcctctttctgaaaacaagatggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctgtatgtgttcattaactttttatgaattttactggatagccaaattttttttcttaagcaaatcgtactttccttgtttcctttctagctacagaactcagtgaagaatctttcccaacattgctcttaatttcgaaattaatgaaggtaatggattaaaacattgtaagacatttctgtatcctgcaattaattctgaccccgtatagaagatttttctgctgctttcatgtaaaaccttatatgtgaatatgtgcttcagccataaccttccttttctttgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggtatgagctcttcttttaaaattgtagttaaaaaaaaaaaaaaagtactctttttgcatctttaaggagaagcaggatggtagttttcaaatgtatttgcttgctctcttaactgtggtg

SEQ ID NO: 8793 - DNA, 1264 bp, Homo sapiens
ttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccgtacattcctgctctcggacttgaactctactgtaactgttttcttaaaggaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagaga

SEQ ID NO: 8794 - DNA, 1147 bp, Homo sapiens
ccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcact

SEQ ID NO: 8795 - DNA, 1286 bp, Homo sapiens
aatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattcttacgtgctgttttatttttttgagacagggtcttgttttgccacccaggctggagtgcagtaatataatcttggctcaccgcagcctcaacctcctgggctcaagcaatcctcccatctcagcctccctagtggctggaactacaggtgtgtgccactatgcctgaataatttttaaaagactttttgtattgaatgaatgggtgtgtgatggaaaaaaaattttttttgcagagatgaggtctcactatgttgcctaggctggatcctgggctcaagtgatccttccaccttagcctctcaaagtactgggattataggtgtgagctaccacgcctggtgtaaagaagtgctattttaaataatctctcatgaaagtgtttgaaatgcttgttccccggtgccgtgaagaaatagcacttgaacataaatttaatttactcagcaaggccatttttacttcccgcagaaagggtacattcgccagcagttttgccacgagagtaca

SEQ ID NO: 8796 - DNA, 1119 bp, Homo sapiens
aactcggagcccttccgccatctctctccaggactagacacccccccgcccccgaacaagggagtggcctggacagagcactggggtcaccgagctattgctcctcgtcccccagccaaaatgggacgatttctccttcctcctccctctcagccctgcaaaacctaaccccagtatcatcaaatagtaggaactggagcccatagaccttctcttgggaagcactgcctctaacaaatggagaaactgaggactggagggcggggagcctgtctgaggtcacacagccaggagtggcacagctggggctggcacgaagtccagtggggaggacagaaaaggggaggtgaggagcagtgggcagagcagttggggaagaggacgggggcacaccgagggaatgcgagggtgcgtgggaagtggccagcacccctcctgccagggcgctgggatcttgcaaacgcctggggtgctgtgcgcgatgctacccccagcgactggccctggagccagagaggtgtagtgaccaggatcagaacccaggtctgtgccggcagagcctgtgttcgccatgccatgcttgctgccacatcagaagctcaggaaactggggtttggctgatgtagttagggggctctgggggacatcaccctgcccaattcctgcagtggccatggacgtgccagatatcgtgggcgttgtgcgtccccctcccaagcaacccgcccctatagcgcacgtgtctcatcatccgcatgtgtctcatcatccccacgtgggaggcgtggaaactgaggctcggagtggcacggtgctctgcccagttcaggatccaagtccacgtttgcagttccagcccaagctggagcataaccctgggctgcagtggcagcatccagggctggcctgagactcaggagacagctcggaacggtccccgttctcggagagaggggcaggtgccggggtagctggctccctgctttggtctcctctatgctgtgtgccctggggccaccccttcaggtccatttctctaaatcgaggggcctggagccagggttctccagtgctcctcccggctcccccagcttgaggccctgaacttccttcctcct

SEQ ID NO: 8797 - DNA, 1105 bp, Homo sapiens
ggtgccgggctttgtgacctcactggggcccttcttctctgacacttggtcggaaacagacttcccaaaaggcggttgtgttgcggggcgggatggggggaaggactcgacggggagaggagtggccccgttggtcaccggtgccacgctggctctcctgctcgagttttgggccttgtttgcaaacgttgacctcgtaaccccccaaatcggaagtgggacccataaaaacgatacctaaaaaaaatcttggacactgaggtgtaggggcaggaaagggttaagcgtcagggtgcggagggagagttgaattgctcacttgtgggctcggagtcccaaagagcaaacagccactgtttttttctcaaacattctcacctcctctggggtccgcagaccttacaaagacgggctttgttgccaggtaggactgccagcagccttcttcctctggcctgtggggagggcaggggctggtgttgccagcctgggcaaggctgagctcaggcttaccctggtgtcattggggccggggccctaaactgggaccctcggggtttggggtcacagggacagcggcactcacggggacccctgaagtcctgttctgggctggctggacctgtactcagcttttcttctttgtcctgtggagaattccaggagtgccgagatccccagatctgggctttttggtgcccctcccaaccccccacgggcccctttgcagaaccccagctcccctcctgccatttgcatccaagatggactctccgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcgggaaggccgccagctccccaggccccgcgctctttgtctggcgtgggggtggggagccgcgcctggccccaggagcttcctggcctctgccaacccctcgctcctgcacactgcgctcattgtctgagatgcgccgagacggccttcgctgacgtggtccc

SEQ ID NO: 8798 - DNA, 2865 bp, Homo sapiens
ccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcctgtagtcccagctactcaggaggctgaggcaggagaatggcatgaacctgggaggcagagcttgcagtgagcccagatcgcgccactgcactccagcctgggcaacagaccgagactccgtctcgaaaaaaaaaaaagagagagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctgggcagatgtttctggccagcagacactgaaggcctttttgctgtgacagtatttatggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtcacgggttgtgctttctttgcgcgctgtcttcgcagatctcatgaacatcttcatagtgtctttataaaatgtaagtgctgtcaccgtgcctttgcagatggcacaggcactgagtcagggagccagccagggtggggcggtgcccagcccaggtgcagtgtgtgggcccggagtgggctgctgtcttggactgctgcggaaggcggtgggagggagaaagg

SEQ ID NO: 8799 - DNA, 3243 bp, Homo sapiens
gagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagctgcaagatgccaaaatcttgtagatgtcaaataaaaagttattatactaacaagaagtggactcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctg

SEQ ID NO: 8800 - DNA, 1368 bp, Homo sapiens
cttgctgcagtgggttcttttctctgttttaatttagaggcaaattgctggtttaaattccaaattcagtgaatgtctttgaggctagagagggaggaggatgtaactggggaaaggcccataggacttcctttgtatttgcagtcatgaaataggcaatcagaaggcctcagggaaataaaagttaactcttcttgaaagactggagattcttacttaatactaatgtgatacattccttaactcattccatttagatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgagtatttatttatttaaaaatatatattgtaggttattttttcaactataatatatttcatttgtgggattttcaggtgcttctgaaccacgcaacatggcctatatgaaccgtcttggcatatggggtgagggtactccatttagagaattcagtgattttattcaagcagtagaacggaggtaatgcagtttacggtatatactcttctcagtagcaatctaagaagtgtgttattcctaaagcccattctctgtatgttaaaattctactgtattggtaattactgtatgttttaattttattcagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctggtgaggaatttttcttaattcctagtgtttatttaatgtatctgataatgtttctgttagttttggcgattgcgatgcctcctgcccatgggaatgtatttctactataaaacaacagatgaagccaggcacggtgtctcatgcctcagcactttgggaggctgaggcgagcaggtcacctgaggtcaagagttcaagaccagcctggcctacatgttgaaacctcatctctactaaaaatacgaaaaaaaattagctgggcatggtggtgtgcgcctgtagtgccagctacttggggaggctgaggcaggagaatcgcttgaacccaggaggcggaggttgctgtgagccaagatggtgccagtgcactccagcttgggtaacagagggatactccatcgcaaaacaaaaacaaaaacaaaaaacaaaaacaaacagatgagttaccagatgataggctgtttaaccaatgtgtttttttttgtttttgtttttaattgaagcagggt

SEQ ID NO: 8801 - DNA, 1098 bp, Homo sapiens
gagtgcgactccgtctcaatggaaggttttgttagtaattactttagcatgtggggatgggatccgccttccccatctagacaggatctttgtcacccaggctggagtgctgtggcatattcatggctcactgcagcctctacctcaggggctcaagcagttctgcctcagcctcttgagtagctgggactacaggcatgcactaccatgcttggctaattttttgtagatacgggctcttcttgtgttgctcaggctggtctcgaactcctgggctcaagcagtcctcctgccttaggctcccaaagtgctaggattatgggtgtgagccactgcactcagtgggatggtgttttaatgagtaagtgtattttctttttctttttttttttttttttaagtgtcaagacctggctttattaattttattcctgaattctagaatgatataatttgtatttaatttgtgctttttaatattttggcaggtttagtgtttcaaatgacttaaagtatgatgctgaaagagatttaagggatattggagcaaaaaacattttggttcattcgttaaataaggtatgaaatctttttattcagttggtcattcaataaatattgactcatctgtgagatgacaataataatagctatgtatataaggggacactttttggaaaactttgatgttactccacagaaagcatagtgagtgctagccactattgttggtttgtggattcctatatgctaaacactgacaggcagtagccactcatcacatgtggctattgaacagtgtaagtgaccagtccaaattgagatgtgctctcaagtgtacagtgcacaccagttgattctctcaattttcagtgttatttttatctttcttttatagtttatatgccataagggtgcagtttagacaggtggcataccttgcactataggtcaccaaatcatatgcgatgtagatagttatggcttgggcagactggtttcagtatttgtacagctaatggacttgagttactcatacctctgctcacatgaaaacaattctgtaagctgaaagacaatgtgtgccagtgtgtttta

SEQ ID NO: 8802 - DNA, 1186 bp, Homo sapiens
tcctaaccggagtttgaaagcaggcgcggggcgcatgcgcgcggccctccggccgacctcccgatagccctggcacgcggaccttcttcccgacaggccgcggggaaaaaagggcggggaaacggaattaccgcgagctctccgtgagcgccggcggaaacagtagtcacgtgactctcctaggtggccttcgccttccccctcccccttcgcggaaacccggccccctcacccctcgcccaccccagagccgcggtaatggaccgtttgggttccggaattctcttggatccaacaactggtaccgggccgaggatagccggcggagtccgtttttggcggcgaagactggggggtggtcaagatgggggggaaatcatcttccttcacctaggagggaggcggggcggagaggggcgcagagaggcgggtgggggaggagggaggaagtcacgtgagggcgctgcgtgcgcgcggcgcctcatccgttgcccctcccccgcccctcccggcggggcgggggggctgggggaggggcgtcaagatggcggcggggaggtaggcagagcaggacgccgctgctgccgccgccaccgccgcctccgctccagtcgcctctggtccttcaaactcacacctcccgggaggagctgtgctggcgccgggtcccgcggggaaagtaagtccttcccttggcccttttctccttccacactccccctcccggacagcctcccactcccaccctcggggggccgtgcggggccaggctggggggacagccacctcgccccggcttggggcctccctcgccgcttgccgctcctcgcggccgcgcgctccggggccctcgggggcatgttcccgacggcggctccgttgtactcgcttcctctgttcgtcagcgccgggccccgctgtcgccgctcgtggggctttcgggctccgggagccccgctgtcccgggccggaggcacccctcttggaccgcggggcagggtctgtgcacgccggctccgctgggttcgcccctttggcttccgcctcacaacccgggggctgcgggtccgggacccgcggggaaagtaaggaccggatccttcccaagtcctctttcgtgccccagcattgctcccggctctgggcgagggagggaggcaggcgacgcggtcgtccttcctaaatc

SEQ ID NO: 8803 - DNA, 1167 bp, Homo sapiens
cctgctgtttgcctaggaaggcatagcgcatagcccctagacagagaaaccaggtgtgtggatttgagctgtgtcactgtctagctgtgtggcctcagacacgtggttgtgcctctttaagcctcagtttcctcatctacaaaatggggcagtctccacctagcagatctctcacgagctctgatgtaactgctttgcagatgagcaccaaggaaccacgtttgtggagtgagggaacgttctagagctggcctgtagtgacggttgcacagctgtatacacttcataaaacccatcagcctgtacatgtaaagtgagtgaattttatgacatggctcagtacagctgttaaagactggggtaagccccagctccccggagacctgctgtgcacagtggcatccattgctattatgaaccaacaccctctcttatcacctgacagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactggtgagtccactgttgcttagagtggcttttctgtcctctgggcagtgaggagaggccaaagggccaggaactcctgattctgtttggtggccagtcttttggttttgttgttgttgacttttttttttttattttttgagatggagtcttgctctgttgcccaggctggagtgcagtggtgtgatctcggctcattgcaacctcctctcaggctcaaagaattctcctccctcagcctccagagtagcccagctaattttttttttctgtatttttagtagaggtggagttttgccacattggccaagctggtcttgaactcctgacctcagacgatccacccgccttggccttccaaagtgctaggattacaggtgtgagccactgcgctcgggctgttgttgccttttttcaaagctgtgatgcaattatcgcctgcttccttttttttttttttttttttttttttgaatctcgatctgtcgcccaagctggagtgcagtggcacaatcttggctcactgcaacctcc

SEQ ID NO: 8804 - DNA, 2335 bp, Homo sapiens
tcaggttgaaaagcctctttatccatttaatcctctctggccctccttcccctccagcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggcaaggccacgtgtgtgtctttctgtttttacaatttgactgtgtcacaccagcatgtctaagctttggtaagcatcctcctggggaaccagaaaagcttactgacgtgattttgagcgtgtttcccagaactctgagctctttcgtttcctcatctgtatactggggaccatagggtatgtgaagattaaaagttaatgcttttttttttttttttgagacagtctctgttacctaggctggagttcagtggggcagtctcagctcactgcaacctccaacctccacctccttggttcaagcaattctcgtaccttggctacctgaatagctgggattacaggcatgcaccaccacacctggccttttttttttttttttttttttttttttttgagatggaatttcactctgttgccca

SEQ ID NO: 8805 - DNA, 1468 bp, Homo sapiens
ctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaat

SEQ ID NO: 8806 - DNA, 1485 bp, Homo sapiens
catcaccacaacttacaaactgtgcgagttgaggcaagtcctttcatttcaacctctgaaccggttttcttgtctgtaaaatggcatagcagtatctgacagggtcatgaggattctaagataatcttagcacagtccctggcacgctgcaagctctctattgtgactctcgatcttcccttgagaggtctggagaagttaatccggcatgagaatgaggggacatgggatttaagtttgttacactacagctctcagccagcacactgccatgatctggctcatggccacaactctgccctcgtctctagtgtcctgcatagcttagtttctcccattttcagagagcagtctcaggaagtagcacactgatcactcacaccaaggccctaccaggtcagagcactaaatattcagtgccgactaatgtgtacttctctcctcagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgctgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccg

SEQ ID NO: 8807 - DNA, 1165 bp, Homo sapiens
tagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagtagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagctgaacagcgttgacacagccgtgacttacaattaaaccctttcaattacagtacagattctgtgtgctacttgatgagatgttacccaaggccagtttggacttactgctttttgtccctcatat

SEQ ID NO: 8808 - DNA, 1066 bp, Homo sapiens
ttatttaaaaatttttttattttttttgagacagtgtctcactctgtcacctaggctgaagtgcagtggtgcagtctcggctcactgcaacctctgcctcctgggtttaagcaattctcctgccctagcctcccgagtagctgggattacaggcgcctgccacagtgcccggctaatttttgtatttttagtagagacagggtttcaccatgttggccaggctggtctcaaactcctgacctcaggtgatctacccaccttggcctcccaaagtgctgggattacaggcgtgagccaccgcgcctggccctctgcagttgtttaataaggcacagaatacctgtagcataggtcagccttacgatgtccatgaattacatattcagacgttttagagcctgatacattttggaaaagaaaaacaacttctacacctattctacagtccgcatttaaaacaataaattcctctattaaaaacgtaaagccgggtttgcttgcgtgccacagggaatatatccaggaaggttattatgaagctgtcaaatcaagatgatgggaataaggcagtttgaacgaacagtcttcccacagtcaggccatttttgctgatttggtttagaattttcagaaatacttagtacactccacctgttctttgatgggaatatctaagaaggctaggtaggttcttagggttagcctgagtcatctaggggctcaactccttgtgaggggaaatgacagtgaacaagttagtactttgctccacaaatgcatgaaaggacaaatttgcatcttctatcagtatttaacttccttttgctaatgacaaataaatatatctatatttttaaacgtgggtgttttgctttattatgctctagtttggcaagaaagctaaagaactctgctccttccctgattttgtaggccatgaggaactcgtgctttctcggcttatttcctcctcgtctggcctctaatcccgcctctgccaccgccgaggtgctgtgaccttcgtctcgccaactctctagccccagcttcatctgcaaggtgggcg

SEQ ID NO: 8809 - DNA, 2321 bp, Homo sapiens
attgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacag

SEQ ID NO: 8810 - DNA, 1157 bp, Homo sapiens
tccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactccagttacaaaggtttcttctctacctcagactgggcagccaatagggcaggcgtttaggggacagtgggagtatacccctggagggccaaggccacatccgcctgagtcaccagggagtggatccttttgcaagttgaatatttatacccttggtaaggacatcaccatgaggacatcaaatagtcacatctgtggtgaaggtctcaagtgttcacacccatggtaagagtgtgtcagatgttcacatgggttcacacccatgtgtcaggtattcacatgatggtcagggtgtcatgttcacactcatggtgagagggtgtcag

SEQ ID NO: 8811 - DNA, 1213 bp, Homo sapiens
tagacacaggcacatgcacatgctcacgcacactcccactcccacccccgcccccacccccaccctggtgaaccgtggggcctctgggggtcaaaagagaaagagaggggagggccctgagctccagggtgaaggaggcgttttggtgggggcggggggggtaatgtgtgtgcgaggacagacatggcaagacagcaggacatctttggggggcagtggtgtagctggcactggggtacaaccagaattcagagcaggggtcaataaactgtggcccatgggccagatctagcccgggccctctgtttgtacaattcatgaactaaaaaaatgattttacatttttaaagggttgtttaaaaaaaaaataaaaatgataacgatacatgccagagattacttgtggtcgaaaatgcctaaaacgtttatgatttggccacgtacaggaaaagcgtgtggggccctggtttagagtggagggagggtgcgccccctcagtagggagacctctgaccacatctggggccctttctccatccaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggtacttctgtgggcacatgcgctgcccccgggatgctctggtatcccttgcccatccttggccccagtccaccgtggtgccatgtggagagtgacaagggcacagggctcagctgggtgacctcaagcctgccaagcaggtttcaccaacttgggggtgtgatacatgcccaccctccctggggagacctcagtggtagctttccatgctttgggctgggatctcagctggaccaggcccccgttgacagcccctgttgaacctctaagaaataatgagctaggtgtgctgggccagaccgggggcgatgggtgaggtgggacctgagaaggaagctgggcccgctgcccctggggaagggcatgatcggaacccaatttcagtccttggggctctcttgagagggtcaggctggagcaagtggtcagaggcagcccaccacgcagccaggcgtctcccaagacacccctagccccaggacgggtgaaccgcagaggagatttcaggagccgtgatcttcta

SEQ ID NO: 8812 - DNA, 1100 bp, Homo sapiens
tctcgtcccgcaggttcatgcagcatcccaagaactttggcctgatcgcatcattcctggagaggaaggtgagtcgctgcccgccccataccccttcggtctccacctccgtgggcaactgcgtggactcagggtggaggccctccctccttgcccacaaggccctggcctgcctggccccttgctccagctgccatgctcccctcctccctccctcccttccttccatctgggagatagatcagtgcaggccccgccctggcctcctgggcccatggaggaggagcctcaggttgctgagcacctgggaatcccgagaaccccagggagagctgcacggccaggcttcctggagccccgtgtgcccgacgggtctcctgccagctcctcaaaggccacgtggagcgtccttgcaaactgggggtggattctggaagcactacgtgcctggcatcccagtgaagttttcgtaggcaggagtggcgtgcctcaaagggactggagggaccagcttttctaggtccctctgagggtcactgactgctttctgacacctctaatgccaaaccagacgtgtggcctgcaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggatgaggctgcatgttggacgtggcccctgggccttcccccagcatcttggggtcagaggagaaaggctgccgtccgtgtgtcttaagcagcattcccctgaatcacgtttctcagagatggggacctgcccaccccagcttggtggacaccctgctcgggcttcctggttgtaggagggaggccaggaggatgaggcacttattttaaaggacagctgttcccagcgcctgcccctcatgagctgataaccgtagaaggagagagaccgagcagagtggggaaaaatctctccatgcctgaaaaaccagtgtggagaa

SEQ ID NO: 8813 - DNA, 1195 bp, Homo sapiens
ctgtctcatcaccctgctggtgacatcattatttgaattaatatagacccagctttgttatacagtggtcctctccttgtctccctgttaactgctgtgttctgagcagcatggggtacatagtaggtgctcattaaaaatggttgattgagtcattgtgacactgtctgggccccagggagcgtctagactaatgggagaaacaggctcatatctagtgccctccagacaaggaagtaggggctccaaggaggatcaagggctcattttagccactgtaggcaggtgggtgaaggctggtgagagtaggcttccaggaagaggtgccctggtagctgggttttgaaggacgctccagggggagagcattgatttcaagtgtccatcgtggctgtcacgtggttgggggaaccaggatttgaggatagtccagcagtgagacccggtcctggagactctgccaactgtcctaggcttcagtgggcagtgggtaggtctcatgttggtggcacaggcatcccgagaggggccgggccccagcggcgtgggcaggcattgccagggccagcctggtaccgcaccgttaggcttccaggcctggccttggggtggggctgaagctgcgggtcactggcacacattggtgactgcagctggaagccaggtggctcaaggcagccctcaatggttaggtttttgtttgtttgttttttcccctctaaattccactttggcattttttaaaagtgaaattctcaagcataattattttaaagtgcacaattcagtggcatttcgtacatttgcagtgttgtgcagctgtcacctctctctggttcccagccatttcaacaacccacagggaagcctcataggagctaaagcagccactccccgttcccctactctctgtctctatggactgacctgttctagacatttcctatatagggcatcacacagtatgcgtcctttctggcttcttccacatagtgtcatggttttggagtttatcatgttgtctcttgtctccatccttcattcctttttatggctgaaacatattccgttgtatggagatgcctccttttgtttatttcatcatctgtggccatttgggctgtggctgttgtgaatagtgctgctgttgaacatttgtgttgaagtttttgttgggacacctgttttcagttct

SEQ ID NO: 8814 - DNA, 1124 bp, Homo sapiens
cacctgagctccgatcattgctgcgtgtcctgcaggggacagtgtgggctgcttggcttgcgcttgagactcccctccccacacccaagttcaaatctggcgttgccttttccatccgtgcctccctagcacccttgtgcaccatgcatttccccctccccacgcttgcttctgccttcccttccacctggaatgcgcttcccgggcatccttcacctggctcctgtgaagaggcctcttccttcttttggtctctcctgtcagaatcagcggctcctgcctcaccccttctctggcgcagagcttgtccctcatcacagggcctggggctttttacagaatggaggaagggatcctctctgtctggttatcttgtcatcgccacgggggtgccctgcagaccacagctctgtgcagacctccggcctggcaggacctgccaatatactgtccttgtctgatgtcccctccctgcccctcttctaggtgcccccttgtttctctcccatcctcacttcctcaacgctgacccggttctggcagaagcggtgactggcctgcaccctaaccaggaggcacactccttgttcctggacatccacccggtgagcccctgccatcctctgtggggggtgggtgattcctggttggagcacacctggctgcctcctctctccccaggcagagagctgctgtgggctggggtggtgggaagcctggcttctagaatctcgagccaccaaagttccttacttcaccccgactccatagttcaaggtagttcaagggttttatgatccctgtactggtttctataaatgggctctaagacagtaaattaattagaacttatcagctgggatgtctcctacatgtgagctggaggcagccctctggatgtgtcaagataccataaagatctttaggtaccaagaagagcctggggtattttgcagataaatcacacagggaatttgtcccgtgtgaagttctgtctacaagcagggagctggacatgtggccctcccaaggacactccttcagcttgtggcctcttctcttggcacctccgttctctgtaaaatatgcccagttggtcttggtggctgctaccattgattcag

SEQ ID NO: 8815 - DNA, 1215 bp, Homo sapiens
acctcaaatgtgacccaaaaataaagacccgtccatctcgcagggtgggccagggcgggtcaggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggag

SEQ ID NO: 8816 - DNA, 1198 bp, Homo sapiens
caggtcgtcttaaagggcttccctggctgggcatggtggctcatgcctgtaatcccagcactttgggaggccgaggcaggtggatcacctgaggtcaggagttcgagaccagcctgattaacatggagaaaccccgtctctactaaagatacaaaattagccgggtgtggtggcgcatgcctgtaatcccagctaccccggaggctgagacaggagaattgcttgaacccaggaggcggaggttgtggtgagccgagatcacaccattgcactccagcctgggcaacagagcaagactccatctcaaaaaaaagaggcttccctgtgtgtcctcatggagcaaagtgtgactattcacagaggaacttccttgagttcctttggttgttgcaaaggccttttaagccccacaggccagctcaactatccaattctagcttgttaagaaacccctggcccctgcgtaacgagccctgttcctcttttctgtcccgcagtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatt

SEQ ID NO: 8817 - DNA, 1056 bp, Homo sapiens
tgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggatt

SEQ ID NO: 8818 - DNA, 1176 bp, Homo sapiens
cggaagttgcggtgagccaagatcctgccattgcactccagcctgggcaacaagagcaaaactccgtctcaacaaaaaaaagataaagtatattgcctctgaaatagaatccttatgtagatttcccagtttagtgtgtgtactttgttttcaaactcccattccttgacaatataggaaaattttttctctaatctctttaaggaacacaaaagtctaagagccaacaaatcacattacctttaagcttgagagcaaggagtttaactttctgctcattgaatttattaggaattatcctaatggctaggagaatgaacagttggcccatagccattgattcttggtcgctagtaagcatcgtcctcctaatagaaaagaggttgtgcctgtctgcaggactcagtccctaggagaccccacgcttcctctgctatattaggtgaaagctttgatcccatgtgttaaagtgcccctttcacaaaaacgaccctcccttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtcccttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgatcaatcataatgggtttttaca

SEQ ID NO: 8819 - DNA, 1152 bp, Homo sapiens
tctgaaacaaataatatgaagcgagtagattggattaagaggtttggataaggaattgcataattggcgcgaagacagggtcctctgttatgaagggggcacgcagatgtctgaaatgctggtaacaggaccttagcattactaacgcctgcactgcgattccctccccacagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgaggtaagtcgtttcccaatgtctgtctgtacccgcccgtcgatcaggtggtgttttccagaagctgtttgaccagaaaagctgtgttatcgc

SEQ ID NO: 8820 - DNA, 1184 bp, Homo sapiens
gccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacat

SEQ ID NO: 8821 - DNA, 5641 bp, Homo sapiens
tgcggggccgcgcgagcgctcgcctccgtcctctgcctccgcaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacagcttgtattggttggtgatggtggtactggaaaaacgaccttcgtgaaacgtcatttgactggtgaatttgagaagaagtatgtaggtatgtgctggaaaaccttgcttgtggaaatatgtgagaaatgggtaagttcatccactcaatcgcatcgtttccgtttcagccaccttgggtgttgaggttcatcccctagtgttccacaccaacagaggacctattaagttcaatgtatgggacacagccggccaggagaaattcggtggactgagagatggctattatatccaaggtaggcatttgtaacttgctgaacggtttttgagaggttttgtgtacttcagtcttcaaggttatagaaaatcaggtctgttccaacaaatagtgtcatttttgggttaaaaaaagacaagtggacttcggggagttgaccaccattttggtggcagagaaaattttattaaagttgtgtcatttgcatgctgtgtcatgctaggcatgctttagaaaaaactatgacttacactgggacttataagtcatatttaaaacaataataggctgttaacagcagtttcagtatttggaaacttaggttcatgtatgtattttggtgtggtgatcaatgaatgtttttactgtattagaaaacaataaacaccagatactagaccagaggagataggagatcttaacaagtgttatacaagactagctgatttcttgttaaattgtttgtactaagttgtgcagagtatttttctcaaatagtttgatttaaaaattgcaaggaaaatgttcattgtaccaaaaagaggaatcaagaaaatactcatctctcttggaacctcacgttgccgataacacattatctggaatcattccatgccttttgctttccttgagcatgtacaaataaacacaagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcgagacagggtcttgctctgttgcccaggcaggagtgcagtggcatgaacatagctcactgtagccctgaactcctgggctcaagcaatcctcccacctcagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggattttttgaatcatctctagtatttgctttaggaaatgctgaagagttagcagagattattatcttttgggggggcggcggggaaggggtcagttctctccagattgtacaaatgggaaaagtctgctctccattttttgaaatctcgtgtctaatgggggaagccttgaaagctttatatgaagttactgcaaaccagtaatagcttattagagcaaagtcattaagaaaaagcatagttagtgcataggtcttgtgtggatataatgtgaaactggtaaattagtagtttcaatttgtgtgagagccagtttttttaaaaaaccacatagaatgggattttttaaaaaattgtatcaatcataaaatgtctagaaaagatgagactccaaaatagcctccaaagaggactggtttcctggctaactgttcacctgaaggaactcaagtacagagaatttctggtttcttttgcaaaaacagatcagaaacacaaaaaatta

SEQ ID NO: 8822 - DNA, 1187 bp, Homo sapiens
gggtatatacccagtaatgggatggctgggtcaaatggtatttctggttctagatccctgaggaatggccacactgacttccacaatgggtgaactaaaaaggaacgtattttttcccagcgtagcatctctaatactctaatactgtgctcctcttgttggctccggctgtccacagcctgggggctgggaagagagtgctgcctgtggaaatgctcgggaaccagagggttcactttctccttttgcatcctgggaggtgacaaggaggtcactctggatagccacaggaggagactttctaagagatggttgctgtgtttgttggtgtgaggggcccaaagttgaaattttatagatatacatcttcaatgttctgttttccctgttaacacccagattttccttttattcttaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtgggtgtgaagggggcagcacctctggtaccctcatgacccccatgtccttcacaggacacccagtagagctaggtagaacgtttaaaatcagtgccgctttcattaagcagacgcgtgtatgcatgtgcatgtgtgccctgcaagtccaagtaagatctttttcagatttttgtttgttttatacttaactttttcttttttgagacagagttttgttcttgttgcccaggctagagtgcagtggtgcgatcttggctcactgcaacctccgcttcccaggttcaagtgattctcctgcctcagcctcctgagtagctgggattacaggtgcccaccaccacgcctggctaatttttgtatttttagtagagacggggtttcaccgtgtcggccaggctggtcttaaactcctgacctcaggtaatccacccaccttggcctcccagagtgctgggattacaggcctaagccaccgcgcaggcctatacttaacttttcaa

SEQ ID NO: 8823 - DNA, 1250 bp, Homo sapiens
cgcccggcctatattatttttatatattcactgctgacaagtccaagaagcaaaatcctactcatttgtttgtaactttcagttaaaagaaaaaattaaggtaaaagttacctgagtgtggtttccaccgtgatggtaggctaccaattttaatccgacctacgtttaaaacactttacagcgtcagcagagcaaagtgtttccagaacactccaatttttaattagtctccatggccaaggaggtagtatctacatacttctagttaattttagttaaataagggatttaaaagcatttgattttgcaactgagacaaaatatgaaggcaaagtgcaagcttattataaaatgaaaataatattataaaacaaaaccttccaggtgttggattgtctagcaagttctaccgtgggtgctggcccctggcattggttcccctccacagggccaagggcatagctgggtgcagagaccggcagtgccgtggtctctggagtctgaggacataagttaaacaagctagtcaagccccagatgcttgggaggcagaggcaggaggattccttgagcccaggagatcgaatctagcctgatcaacatattctctatgacaaaagaacaagaagaagaagaagctggtggtttctcaccataaccttttcttgtggaattctgcctcagctcttctgggaacagtgagtgcgtgttttatttagtaggattgcatttttctaaactggctgcaaacctgcctcctccatccaagctctgccagcaataatcatttccagggatccaagtggctttaaaatgcaagttagaaatgggaggggtggtgatctcctcagtaatatgaattattggagtataaaagataactaaattttaaccaaaatattgaaagtgttaatgctgttgttatcagatagaataaactgttacaaacgcagcctccactcagaatggatcggacttgtcacttgggcctgaacagacctaattgatcatttttcatgactgctgccagcccacagtagaataccgcagttgttaatatttctaattgggtaggatgctacatggaatgtattttgttttatatattaaattactaaaattctatataaaatacagaaagttaagattagaaagccttcttacagcacaacgaatatttatttaatggctatactgttcctgtggttgaagtcccatgtatttagtatgtctaagttatgggcgactct

SEQ ID NO: 8824 - DNA, 1680 bp, Homo sapiens
caagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtcaccacttgtcttcgttggcttgtcactgttttcagggttctgtcattttctttctcagccgaggcgcaggagcccagggcccctccacaggtgcccacaatggtcgacacagccctgggagcagagccccagggcagaagctggatgtgttgagggacaatgcaaacccctgcgccacaggaagcctctcccgccaggctgggggtcctgcacagggtgaagagagtccagagggcagggcatctgccttggtatagctttgggcacctgctttgactcctttgggggatacacctaggaggggctttcggggccacgtggagctgtgtgttaacttccaagaagcaacac

SEQ ID NO: 8825 - DNA, 1540 bp, Homo sapiens
tcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgaggtaagaaacaggagttaatttgtttagtacaaatcttctagatgatcagagtctatgcgacaatgaattaagtaataatttattgagcctgcggtatttctaaggtatttctaaggtgttggggcaaggatttgacccataagtaaaagtgaagaatgtgtttggcctccttcatgggaaggaagagctgttgagcgcagaagtgtgtcaggaggaagggacggagctgcgctatgatgagtgcgtcttcaacacccagtgttttcattgagcaccaaggattcatctcaggttcagagaactcagcaagcgtgtccagtttttttccccttgtatctgggtgtgtggtttgttggctgacgctgacagctgtcaccagccaaacgtgtgaaagcccagcaccctttgtctggttttccaagtttcacattttactcgtatagatctccttaaaaacaccatcagcatgg

SEQ ID NO: 8826 - DNA, 1226 bp, Homo sapiens
cagtcgatatcatatgcaaagcccctggagacatattcttgccacactaatgggagccacacgtcgcattgtcatagtgtctttcaacaatttttactcctatgtttttcctaattgctgctgttgtaggggtgccctgtggtgatctggtgcttgttttgcttgatgctgacttgcaaaggtcaagcgcctctctttccttttgtgtgtgctcggttgtggccaacttctcgtgtgagtgtggtgggtcttggacaagcactggggtgttagacgtgtctccttgtgactcattggtagaagctgccacacttgggaatcagtgcttttggcacttttcttattttgcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacaggtatgagaaaagatagaggaaaaaaagaaaatggtttgcaggatttgctggctacctgtgtgttagacagagtgtcacaccacactgtaatttgtgtattttctcttagcagcttgctcccccaatttagaacaattactcaattcagtacttgcaatacagttttatttggctctatgatattatctttattaaagtaatagagaactgggctgggtttggtgactcacgcctgtaatcccagcctttgggaggctgaggcgggtggattacctgagctcaggagttcgagaccaacctggccaacatggcgaaaccctgtctctactaaaaatacaaaaattagccaggcgtggtggcaagtgcctgtagtccaagctacttcaaaggcttaggcaggagaatcacttgaacctgggaggtgaaggttgcactgagctgagatcacaccattgcactccagcctgggtgacagagtgagactctgtc

SEQ ID NO: 8827 - DNA, 1134 bp, Homo sapiens
ggaaggtaagtggaggatccagaaagcggaattactgttggatatcttttctaggcacattatagataaaaccattcttggaaatgggttctcaaccagctcttctgcaattgcaattgcagctccgcgatacatggcaccgtctagcagcactgatggcctgccaccccttgccggagtgttccacctccggaaatttacccgagggagacaggctcacagagtggaaagatgcagagggcaggctttcttggcgttgtgtggattgtgggctgtgagaagtagctgagcatgcacgctcatcagcagagcttcaccaagggtgtggcagcacctgtgtattggcacggaggagggtctgcttgccgagtggccgttagagggggcgcgtctggatgcccacgttagggccctgccatagaaatcagttttgattcttaggtgctttttttgcctcttcatgcagcaagactttttttctttttctctctaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggtgcgtgcgacccagaggcagcggggagggttggctcccagggcccccacagctgacccaggtctatgcgtggtgaaaagaaaggctgctaatgtagttaggttatctgctgctcttgggaccttgctggtgtccttggctgtggtatgcctggctctgcagatgccttttaggctgtgtggtgcagtgcaactgcttgcctccctgagcagcaacctccttgatcgtctttgcagcagttttagggtagggtgggtgtcagggctgcatttgacctggtgcctcgtgtggtggaggctggtgtggccgaaccacacatgtgtcgtgagtgtggcaggcagaggactccacccccacggtgatgtcattgtcttaacaagtgacatgtgagtgattctgaagtgatgcttttgcgggtgtcatgaggctgggagggacagacacgttagatgattaaaacgagatataaatgac

SEQ ID NO: 8828 - DNA, 1183 bp, Homo sapiens
acattttttggcccacagaggctgggtcgcttggtaacatctctgatggccgccggtttattcatagagatgacctgggaaactatcttctccagagtaaaagaagtcagaaagatgtagtcacacaagatccaaagtggcagcctcgttaaacagcagcagaaaagccacaggcatctgggctaaaaacagggttttgttctatttcttcattctccttgactgctgtgatctgggagtggggatgtccgcctcagtacctcgaacagcatggcaggtcctcagcagctgtgtgtcacccaccttccatgagggacagagggtagatggccttttcttgacatggagcaagataccttgtctcttagtgtgtcgtcatccactgtcggtgatgggttgccactttcctcacagtaactgaactttgcattgatttttttgtgtagatttgattttcagtttgtcaacttatttttgtactgtttggaagtgcctggagtgtgtggctgtgatgtacacatgcctgtcattgacacctagtggacctatgattgcaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaaggtagggtgctctgagcaggagggagacttggcttggatgcttctttctcttccatctaaggcgagtggaaagcattcatgtgtctttgactgtatctcagaacagcacagtctagtgtgtggccatctctgatttctatagatgtgtcctagtgtcagcctgatttattttctttttcttgtgctttcaaaggtattggttggatataaccagcctccactgtccttaggtttttgttttgtttgtgttctcacaagaaatttggaatcatgagaaatcttgcttgtttgtatatcgccagtgtgctccgtttcccctgggagtgggagtgtgtggccgcccacgcagggtctggttctttgtccggcccgagctgccactcctcatcctgtctcgccacctgcttcacctctgagtccccgctctgtgcctgccttggccccaggtctctctggacatgctctgtc

SEQ ID NO: 8829 - DNA, 1064 bp, Homo sapiens
gagtcttccggaggggcctcctgtcagctctctgggaggcgggagagctaagattggaggggctggctgagagcggcctttggtgccccacgaaggcatgttctgagcaggggtagctggaggagggacgtggattcgttgatcaccatctgcatgctgtgcccacctgttgtcactgtgtttcctggtgactgacttagcatcttacatcttttgtttgcaggcttgtgagtggcaattccattgaagagaaattgttgaaaaatggaactaaagatctgatccgagaagtggctgctcagggaaatgactactccatggctttcttaactcaggtactccttattcaatgagaggcctgaggtgagacccgccatgcggcgcgtggaatcgcatggtgttagtgcacactagcaaggggcttaggtctccagctgaggtcagatgcacacttggaccttgtactggggagtaacacacatctctgtgttcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggtaagaatacattgaatctggctgaagagttgcacggtgggagccggcggaacacctgcaccctcccccagggttctgggtgctcagtccccactcttccctggcctgaagccctcttcccgtccctgcttttggaacctccccactcccttctttctgtcatggggattttgaactgtaaatacaagtgaggggaatggtggcgaaggtcgcggaccacaggcctgtcaccgaagcagtcgctgccgtcttcatctgcactttgccacagtctcagctccttcccctccccatggaaatctatccctgcctcctctggaggctctgcgggcactacccctactcccctctagctggctgtgttggcttctccctgagcagtgcagccatgagtctgcactcaggtgctgagtgtaaggtgctggt

SEQ ID NO: 8830 - DNA, 1629 bp, Homo sapiens
ttttggtcagtgaaaaaaatttgcaatattttcagagttaagtttgatttgaagtaaatgtgacttcattaaattaaagtcacaaaagccaaaacccacaagtatggaaatgaacttaaaatgaagagagtctcgagaagcccgtagggaccgtggagcttgttcacccccacgtagggaccatggggcttgttctcccctcgtagggaccgtggagcttgttctacccctgtagggaccatggggcttgttctgccctcgatgtctttgactggatttgcagcaggctgctgcttgtgggggtgatgcattgtggagcagtgtgtgtagagaacatgtggctctgagacaacagggaaacctggagcagggactcgggggctgctctgagctgcactcctgatcctgaaagttcttgctgctctccccgtcaggacgcagtgatgactgcagtgagggcatgggagttctggaacctgaagaccctgcaggagagggaggcccggctgcggctggagcaggaggaggcggagctcctgacctacacgcgagaggatgcctacagcatggtacccggcccggggccctcctgccctcttgcccccctgctgaggggcacttgtgcagccatgtttggcttgttcaaagtctgtgtacattgacatgagaaaatgcctaggaatttttacttctcatatcaacacaacctcacttatgttctaaaaacacaattttcttaaaaattgacacttggagattgtcagttagatattgaccagctctgattaaaacatttataagtcttataaatagtcatgttgatcagaacttatttgaaagacttaatgagtatgaaggtacatgatttgtggcttataacatgacactgagacttggtggaagtcagagcttgccgtgttccctacaggagtatgtctacgaagatgtcgatgggcagacagaagtcatgccggtgagtgctgccctctccctttgtgtctgtgtgggcagcttcctgtgagttccacatctcatgggccttcccttctccatgcagctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcaggtgcgcatcccgagggcgtcacatgacctgggggggccctggcctgcagaatccctgcatgtcagccactttctgctgtctgcctgtctgctgtctgcctgtctgctgcagggctagcgatcacacgcccatccgctgcctctcaggccatgtgcacaggttatgttgtttccagtgaggaaaccttcgtgtttcattctaattgaccatgaaggcccgaaagcaggtctgtctttggcaggtgctttctgtggcctctttgcccaggcacctccagacttgcctgacctgtttcctttgtcttttgcctgcccgtgtggaatctcctggtttactctcttgctgaagactgcctctctgttcagctgcaggcaggaagaagaagcagcgtcacggggaggcggtcgtccctcctcgg

SEQ ID NO: 8831 - DNA, 1238 bp, Homo sapiens
ttgtaaaacatacctgtgacgcattcacttcctgacttcctacacacttagagagcaggtactgcctgtgtcggtgtctcaaagcatgcccatgtgtgctcccccacacaggtcagtctttaatgcctgttgtagaaaagctgtaaagcacacaagaagcattgtgaaaagaaaggcagggtgcggagctgcggactgtggccatgcacaccacgctctggtgtatctctgtactgtgtgcgtccgtgtgccacacagacgctgaaatcatatgcgcagaatcacacctgcagagaataggagctgtgccaaattggggaaacccacactttggactaccaggcaggcataaaaatatttttgttacatagaaccatttcctgcagtagtttttagaaaattgtttgctgtagtggaatttttatatgtactcaggcaacttcattcctcatttattcaaaagggatctttgtgaatacttacttggtgcaaggtgggcaagatgggcagtgcccacattctggagccacgtcctacaggggagggaggcagccaaagggatcattttaaatgctggcgggaggagtcagggtggcacaatgcaggactggcttgttaggaaacacctttctgaggacttggcatttgagctaaggcctgaatgacaaggagttggtcataagaagaacaaaacagcaagtacagaggccctgagcttggctgatatgggggccagaaagctcagtgtggctggactcaggtggtgagggacagagggtggatgaatggagtggagggacggaggagtggagggacagtggggtgagggtggagggacagtgggatggagggtccctggggtggagggacaatgggataggggtggagggacagcaggtagacagagggtgggggcaccgccaggtggaatgagctggggaggatgggacaggtggctgtgtgaatgtcgtggagtttggatttgattctgaatgaagtggaagcctttggaggatttatgcaggggagagcctgacgtgaaattcaaatggattttttttttttaaataggcaggaaccattaaaacatcagttactgggacgagcatgcccactggtaagacaaatacagagatgctgaaatgtggaccccatttctcctggcgctgttgccttatgcccgcctgtctccgcaggtgccgtgagtggaaatgtgatcgtgaacaccatcgcagggg

SEQ ID NO: 8832 - DNA, 1120 bp, Homo sapiens
cagatgtacacaatatgatctgcaaaaatggtgcataccagtttgttaccccgtgtactaaatattttctttatgtctgccaagtttttacattggatttgagagattgtgatcgctttcagtcacctaagtagcagccccgtgcaggtgtgacaagggtgtcagggtgccccaccagcccgactattcagggagcagtgtcccgggtggggtgggctgcaggcaacggccaggcctcctggaggagaagctggcggccatgccgcatgggcagaggtaggcctggaggcagcggcagggatgggacagggggcaggagatgtgggtatgcacagggttggtctgggaggtaggctggaaaggggctgggttctgccatagggcccagagcgggcaggcgtcccgggagtcttgagcgcggcatggtctctgcggccctaatttcgcagtctctccccagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggtgagcggggaacagggtgagggcccgagtgtcaggagtgggtgcccggcctttggattgtgtgtctcgcgggctttgcgagctcccagcccttgcggctgcactgggtggtgcactggagggaagtgttgtctcctggcctcaggtttcaacccctctggctcctgggaaggctcctctctgccggggcctgttccagctgtcgccagctttgccttcatgttctggacgtcgatctccagctctgtggggtacagctgccctctcccagttccaggctcctcttctcccttcctggtgtcttttttaaaaatatattttattttattttttgatattttttgatatttcttgttcatcaagttctacctggtgtctttgggagaactgagttcctgatttcatgtgtgcagtgtgccctcccgtcttcctctctgcctagagcttttatgtcctgcttcctcccagagcttatggagttacctccctgcatccttctctaagagcggggga

SEQ ID NO: 8833 - DNA, 1103 bp, Homo sapiens
tcccggggggagcgggtgtctgcctggggggagcgggtgtgtgtccgggggagcgggtgtgtttcagtgtgtgctgtgcctccccgtgggtgcacgggtgtgtttcagtgtgtgcctgagagaagcaggtgtgtttcagtgtgtgccgtgcctccctgtgggtgcacgggtgtgtttcagggtgtgcccgggggaagcaggtgtgtttcagtgtgtgccgtgcctccccgtgggtacacgggtgtgtttcagggtgtgccatgcctccccgtgggtgcacatggcacggtggagggctccttgcacatgtgcctggacttgctgtgggaatggcctgggaggctgggcgccgacccctgccccccggacctggaggcccagcaccatctccccggcccccatcaccactgtcccctgccctcctcatgactgtgtttcattttcccttaagtatcaggaggaacattaatgacaacataaaacccagagctccataaaagccatttctacagattgacggcctgctgggctcgtgggagggtgggggcctggactctgcccaccccatccctgcagcccccgaaatttccaggccgtagaggctccctcactaaaccacagcagctttttatagggtgtgtaattaaaccaggaatgacccagtgtggccaggccagaggggacacagcctggtggggacggccccccactgtctctgtcccacagcttctgctggtggcagagcaggaagcggcaagggagcggcatgggcggcgcggccacaggccaggagtggaccccaggatccctggacccagcctcatgggcaggaattggccacttggctgggtcacagcaggggctcagccaggccctttgcacccccaccccagctcccctgaggctgccctttcacctgaggttctgtctaaagccctgggctcagctctaccatcctgggctcttctctgccaccctgggctcggctctgccaccctgggctcttctctgccaccctgggctctgccaccctgggctcttctctgccaccctaagctctgccaccctgggcttggctctgccaccctgggctcggctctgca

SEQ ID NO: 8834 - DNA, 1176 bp, Homo sapiens
gttcccccaggtgtgcctttccccaggagtctctgctgggccacaggccatctgtgtgcggggacaggcaggacacgtgcccatgcacgtacagacgcgtgttcacactgagacgggcgcacgggcctcccctcctggggccaggcctcccccgcagcctgctgggtcctgagccctgggaggagggggccgcacatcaagcaggcgccatcccagtggaaccccgaccgcgaaggcttcctccctcggcccccaggcgcttcctgaggctccgagtcagcccggcccaggctggggacggccccgtgtcccgggatgggaccaggatgctggcctgcgggtggctggaccctggctcccggggaggggctcaccgtgttctctcttgcctctagatgccagcctggcggtctcattcagccagccaatcatgtattgccagcctcattcgggaattctgattggtacttggtcacaggctcctctcttacctgcacccctgggcccgcacgtggcgagcggccaccccggcttggcctgccgaccccgggagtgccaggtgactatccgcctcgccccgccgggagcccgcggccaacgtgcctctctgtctctctctctttttctcttgtagatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccggtgcgtaggcccgcgtgctggcagggggcgggggcgggcgtggggcggggacacgcagcaggcacacacagacacacgctcgcacacacaccagcccaggaggaggtggggggccggcggcacctctctgtcgtctgtccggtccccaacgtgccttctggtgtccccaccccaagctgtgccatgaggcccccaccctcggcagtggtcctggacttaggcaggcaccccgtgcccacgtgcatgggacaccctcacgcctgcactagatccccagtgccagggctggaggcccagacaggcctgagggcacagggaccatga

SEQ ID NO: 8835 - DNA, 1675 bp, Homo sapiens
cggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtcccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaactgtggtcgcgtgttctgtggtgttggggggccaggctcacccaggctgacccctgcagccgtgcgtccctcctgcagcaccttgggatgctgggcgcctcggcggccccacgc

SEQ ID NO: 8836 - DNA, 1152 bp, Homo sapiens
ccagaagtctaggactccgaatagcgtgtgctttgtgtgtgtaccacagacattaccacttacgcccagtgacgagatcatcgtcgtattctcgccaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggtgactccccagccaccctcgactgaactgggggaggctccagcagggtggtatggaggaaagaaacccgcccagggtgtgggctggggaacagcagcgacagtggactcgttcccacaggtgaggtgaatgtcagcagtgtgtctgccaaaagtggcctttgggcagtgggccgggcagctgcaggggcacagccacatcccgggcagaagtcacgtgggcagccagagcccccaccatccagcccttgccggcctgtctgcccgattcttccaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccaggtatggcctgcaccagccgcccatcatgtgcctgcctcccacacatctggggtgacggtcttgtttccttctccagggagtatccgccatatctacctgtaccaccacgcacaggcccacaaagcgctcttcgggatcttcatcccctcacagcgcagggcatccgtctttgtgctggacactgtgagtcctgggccctccatggcagcacattggctggggcagggtttggggaaggaggacatctcccagggtgcccaggccctccaggtcttgtcctcaagggcctttgcccatgagtgcttgtcgtgattgaattggcagtgccgtggcagtggtggagtctgccccagggctgcccccacttcctcctgcgcagggggaggctgacgtggcctgcgttggtctaggtgcgcagcaaccagatgcccagccttggcgccctgtactcagcagagcacggcctcctcctggagaaggtgg

SEQ ID NO: 8837 - DNA, 1157 bp, Homo sapiens
agccacctgcatgatggctggtcctggagtgagagaggctgaaccaggagctaaggtgtgcggtgaagggggcaaaaggagagtgacttggctttgggattcctgggccgctgtagcctgtgaacactgtaactaggggaccgtttttcttctccactcctctctgctaggggcctagcacagcgtttggtacgaacaaaggctcagtaaatgcagtaatggatgggtggttggaccagctgaccaacaaacgggtaaacaaatgaactgggtgactgaggctggataactggccacggcctcccgctgaccgtggcctgttggactgttcttttcggcagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaatggtgactttaatctctcagaacaattgctgttgctttgaaagacatgcatagccagatgttttttaaattttcgtgtgtgtggtacgatacataaaacacaaaatttaccatgcatctggtcgtggtggctcatgcctgtcatcccagtactttgggaggccgaggcaggaagattgcttgaggccaggaatttgagaccagcctgggcaacacagcgagacctcatttctacaagaaaaaaaaagaaatacatatatatacacacacacacacacacacacacacacatatatatgtatatatgtgtctatatatacacacacacacacacacacacatacactcctgggatatcttcctgccacagtctcccaagtagctaggattataagttcccacccagccatacctggctaattgttttcttttttttgtagagatggggtc

SEQ ID NO: 8838 - DNA, 1217 bp, Homo sapiens
tgcggcactcaggtgcctttcaccttccaggtcgggagcaggctgaactcactgggctccgcctggcaagcttggggttgaagtttaataaaatcgtccattcgtctatgacgcgcgccatagagaccaccgatatcatcagccggcacctgccaggtgagtgctgcgcgcggggcctccatgcttgcagcagtgggcggctcgtggcagggccccggcctgagctcctggccaccgggaggtcacagcatctccgccggcggggccgcctcacccagcgcttcgctgtgcttctctgcaggcgtctgcaaagtcagcacagatctgctgcgggaaggcgcccccatcgagccagacccgcccgtgtctcattggaagccggaagctgtggtaaaaacctccccggggggcagctgtgtcaccctcgccttccctgggcaaagcggccctgctgggctcaccatccaccacgtgcccggccgtcccacgggcttccccgggcggcgatggggtctgtcctcctgacacccgccctgcccgagcacttccgcactgacggctcctcactctgcccccagcagtattacgaagacggagcccggatcgaggccgccttccggaactacatccaccgcgcagatgccaggcaggaggaggacagttacgagatcttcatctgtcacgccaacgtcatccgctacatcgtgtgcaggtaggcagctgctgggctgggcgtggtctaaaataatttcagacttagagaaaagcatgaggaagaagccgagcgagaccctcctccactgccgatgccaccctagtcaggcctcaccagcccccgggcgtccacttcccgcgagtcctagtcagttacgcggtaggtggcgtgttacttggagcttctcataaggctgttttgggcaagggtggtgcagacagggagggacccctgtggtgtcctgggtggggtgcgtgctgggtggggggtcctgagtggggtgcgtgctgggtgggggtgtcctgggtggggtgtgtgctgggtggggggtcctgggtggggtgcgtgctgggtgggggtgtcctgggtggggtgcgtgctgggtgggggtgtcctgggtggggtgcgtgctgggtgggggtgtcctgggtggggtgcgtgctgggtggggggtcctgggtggggtgcgtgctgggtgggggtgtcctgggtggggtgcgtg

SEQ ID NO: 8839 - DNA, 1215 bp, Homo sapiens
tgtaccccggccctgaggctgctctgagacttctgaggggctcagcctctgtttgtagaacagagccccctggcacagcctggcccagcctcttttaaggacagagtcccctggctctagcccagcccgtttttttttttttagacagaatctcgctctgtcacccaggctggagtgcagtggcgcgatctcagctcactgcaagctccgcctcccgggttcacgccattcttctgcctcagcctcccaagtagctgggactacaggtgcctgctatcacgcccagctaattttttgtatttttagtagagatggggtttcaccgtgttagctgggatggtctcgatctcctgaccttgtgatccacccgcctggcctcccaaagtgctgggattacaggtgtgagccaccatgcccggcctagctcagcccgttttaaggacagagccccctggctctaacgtgctctttctctctctctctctctccccagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctg

SEQ ID NO: 8840 - DNA, 1140 bp, Homo sapiens
agtgagctgcgatagcaccactgcactccagcctgtgcgacagagggagacaccatctcgaaaaaaaaaagaaaaattctttttttttttttgagctggagtttcgctcttgttgtctaagctggagtgcaggggtgtgatctcggctaattgcagcctccgcctcctgggttcaagcgattctccagcctcagcctcccaagtagctgggattacaggcatccgccaccacacccggctaattttttgtattttcagtagagacgtggtttcaccatgttggccgggctggtctcgaactcctgacctcagatgatccgcccgcctcagcctcccaaaatgctgggattacaggcgtgagccaccgcgtccagccaagaaaaaaagtttttaatgaaagaaacagaaactgatgccattatataatgaaccctagtacccatcacccagcttcagcaggtgttagtattttgtgactctttgatttttttgtcttgggcctaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatggtaatgggaccgtgtgtaggatttcctcacacagatagcacatacgcggaggggcgggatgacgtctgaaaatggaaaactacagattaagaaggaaaaaatccaatcccctccatctcatcaccccagttaaccattgttaacatttttatgtagaacttttctgaaatatttgtg

SEQ ID NO: 8841 - DNA, 1501 bp, Homo sapiens
ggaaccgaccgtgtgtgcctacgcgtgcagaccctcctggcccctcaggtaaaggaaccgacggtgtgtgcctgcgcgtgcagaccctcctggccccgcaggtaaagtgtctcgtctaccccctctgccatcactgtacctcacgtggcctccaccacagcacgtcatgtctgccattgcgtgtgtgcccattacatggcgagatccttgaagacagagactcattccccgtctgcctcccaccaccttgaacactcccaactcctaaagtgccaacacaggtttaatttgccgaattaaatcttcagttctgctgattctgctgagtacattcctctgctacaaagctaatggttccaaaacaaaatgattaagtatttgaatcctggagcatcaacactgccttttaaaatacagcaaagtctaaactagtccagctgaaacatctgtgagcttcagttccaatgagggagtccagggagttagaaactggaagagcaccttttttcagtggccgggaagatggcggacattcagactgagcgtgcctaccaaaagcagccgaccatctttcaaaacaagaagagggtcctgctgggagaaactggcaaggagaagctcctgcggtactacaagaacattggtctgggcttcaagacacccaaagaggctactgagggcacctacattgacaagaaatgccccttcactggtgatgtctccattcgagggcggatcctctctggcgtggtgaccaagatgaagacgcagaggaccactgtcatccgccgagactacctgcactacatccgcaagtacaaccacttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctgaggctggacatcagcccgctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgagagggcacgccaacatggtgacagccaaccgcaccgagctgagtccagtgcaatcacagattctgctcacttaattcccctgctggtgtccaagcagcccacctctccagaacagagaccccatgacggtgactgtaagtcacaaagacggcccctctttacaggcagctcctcctgaagccggaccagagagagaatt

SEQ ID NO: 8842 - DNA, 1244 bp, Homo sapiens
tgcaaagcacttgtgctctcagtgttgcaggcaggatttgtggaactggatggcatacttctcacattaagacttaacacttgcaccccccacccccgtgttccacatgagcagctctgccaacaggctctcttggcatggggagcagaccttctatttcatcaggctgaccttggccaacatctccctggatgagctctggcagtctgcctttaaccacagcgagatgttctttgctgaccaggtccacaaatgctgcaagtgcatcgtcaagcagggccagaccctcttcatcccctcaggtgagtgcaggcagctttggggaccgtgtcctagggcttgccggccctcatcaaggttacgcctctctccctcgggctgtgtccccaccacggggtctgtctgcatccctggcatgcctgctcccttgtccggagcttaacgccaccccagcccagtccctgcagaggggccagcaatggagcttgtgctgtctggtcagcatgggcactcctcaccaccgaggccaccttggagctgcacagccagtcagcccctttcacagcctggctgggctcactgtgactgagcccatggctggagacccagctcagagagccttgtgtggggacggcagccacggcatcagagccagtgagggaggagggtgctagctcctaattaaggcaatattagaggacattttctgtctgtgctgaaggagaaagcccgtcgtgagccactgtgtgcccctagatgatggaagaacaaatcccagacatcccgctgtttcattaaatattccactatttctgaagggctgcctttccttctaaagtaacacagctacaatactgttctcacacctcaaaaaatgaacaattaacaattccctagtattctcaaatagctaagttgtgttcagagttttgaatcgttttatagggtttttttttccatttaaaaaaaagtatcaactgaggccttcacattttaatgatttataagcctcagaatcttctgtaatctctgggtccctcctctctccgtcggcttcctcaccgtcacagctatttaagaaagagctgtggatttcccaggatctggcccaggctccgtctccaaggataacccggggtccagtcccagctctgggggcgatgcagctgccccggccttgtctcctgcccctgagtgtggttgggaggccgggtggctggacacaggctggggcttcctctctc

SEQ ID NO: 8843 - DNA, 1205 bp, Homo sapiens
ctctggccctaccgacgtccgcacctgaggcttccctgctgggggatcaggcactgtcagctcctcggggccgccctcagccctgggacgccctccgccccaacgaccctcctcctccccagcgtcgcgccactcggcggcctcgccggctcccctcccacccttgaccttttccgccacagctacagaacgcccaagcgctcttccgcctagggtgccctccctgccccgcccacctgcgtcccgcgggctcagcggtgttacgccgcgcccgccttaatatgattggtttttgttcctgtcactctaggatccaagcccgccattggtcggcttccgttacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgagggggtatgtggaggggccccggcgcggggctgggcggggagctccgggcctggcggggaggacgcgagctggaaacagcacgggcagacccaaaacaggagcgggggaggaatgtgagagttcaatgcaagcacgcgaaatcgtgggaaaagcgaagtgacatttccaactgcactcttagggctgagtgtgtgagggaagcttcagcaaattttggaggattgttttggccgaagagacgaagcagtttgggatgtggtgtgtggtgatcacaaggctgcaggcagctggtgaagggagctgctgcgctttggcgtgatatgatagtgaagtaatgcttctcgtcgtagtccactgtccacgccatcgttacagtgttttccaaaaccgtaaccaactccctggtttaaaatcttccggaattttcatttgcccttggagtaaaatctcaatcttacccagagggtggcatttaaaggccttcataacctgatcagcatcatccctctctcccctatgcgttgtatagctcgcagccacacagaaatacttggaa

SEQ ID NO: 8844 - DNA, 1923 bp, Homo sapiens
agattaatatgtatgattattgtgaagtttttcaaaatacttaattcagatgtttaaatgtgcttattagtgcatgttattacattaatttttaaaactattttcccatgataatctttcaaggaaaacactctcagaagtttccatactgaaatcataattctttgtgtatgtttgtattagtgctttctatcttcaaggaattgatgtgaagatttttttttagaatgtttacttttaaaaaaccgaattgatgctgctccccagttttatttctctgatttttttaagaacgtatttttcttacatagcgtagtttcatgcaatataaacttttgaaaaaaggaatcagagatttattataatattgtttaggcttaagattacatttgcttctgtcacgaaatcagttctttgttctttaaattggggcatagcattagcaatatgtaaatcttcagatgctgcatttttttaaaaaaaacatagtaactaattaaattgctcctttcttccttctatgtgtgatcctgattctgctggactttctgccgaacttcatgacaccaccacttgggattttgccaatttttcttgtcacttatatttggcgtgttccaaatggacttcatattctattccttattgtgtggtatcatagcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagtttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaactgttattagtggtattctcttacggtcttactaaactttgctgtaacagtaatgctttggttgctttaactaatcctatcattaaaaatgaaaatgattttgctttttaatttgcgcaagtagcactaaagatagaagcttaattaatgaaagctaatgtcaataaggggtagatagagtagtatatgtgggggtgggagggtatgggagtttaatttgtataaaccactgatgttctgtgaaatcggaatttccagctacatttcatatagcttctgaatattcaggtattctgagacagattattaaggatatctttgtcctgtgctgatttttccaaataaatctttttcatcttgaaaaaaactgtttgaaggcaaatctcttttgcttataaaaaataatgtctagttttaaacatatctgccattatttatttggttttaatatctagaccttacccgattattatcgtacagttagtgttaaacattctttaaaataaaacaatactgttgggttggctgtgaagtgaggatttgctgtgtgatttgtggtgaattaggcatttcttgagaatgtaggtttctagaagtattaaaagatggcttgactctgcagtgttgtaaatatttccctaaaatttggacatttctccagtaaaacgtgtctgatgggttaggaccatttgtctccaaggaatggcagtggttttctttttaattgtttgtttgtgtttttcaagataatgctgagagacatccaag

SEQ ID NO: 8845 - DNA, 1209 bp, Homo sapiens
caggagttcaagaccagactggccaacatggtgaaaccccctctctactaaaaatacaaaattagttgggcatggtggcacatgcctgtaatcccagctgctggggaggctgaggcaggagaatcgcttgaacccgggaggcggaggttgcagtgaactgagatagcgccattgcactccagcctgggcaacaagagtgaaattccatctcaaaaaaaaaaaagaaaaatatttgtgaagccataaggtttagaactgaaacatagaatttcatataaaatattattttatcccaaatcacttgcagtacttagaagaacactgtgtcagggcttggctattatagtcccctgggggacagaaatacttcaaaaattctttttctttaatttgaattccaaaaagtagatgcttgtattctaggctttcttatcacagttaacatcttagttttgtatgtgttcttttcaaagcttttatccagtgtgatattacaaagtagatcatgtgtcagagtaatttttaatttggaaaaataccttttaatgtttagtaaacctaactcaaaatgatttggttaattaggtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgagctacactaaattataccttgcgaataagtgttaacattggttatttataagtattgttacagtactttccagggcatatcattttgtttcaacttatgtgggggtgaggaaagcattgtaacaaaaatgttttttatattaagagatctacactgtatttagccaggtgccctcagacagatatccgaagcaggaatttggtctttggtctctgttttaagcaggatttgacttgtaaaatcaactcaaaattattcttgttaatggagtagtgctgatgcaaaactataataacttgtagtagactctaatgatgatcaaaactcttattttgtaatagttatccctagttttttgttttgttttgtttttttttttagatgaactcttgctctgttgcccagggtggagtgtagtagcatgatcccggttcactgagatctctgc

SEQ ID NO: 8846 - DNA, 1418 bp, Homo sapiens
tttctctttttcctcccgcctccaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaa

SEQ ID NO: 8847 - DNA, 1199 bp, Homo sapiens
ctgtgggcccagggcggggagaaattgggagcagatggcaaaagggagtggcaatacattcgcacctgtgtttgcaagattggatattactgaaaaaggctcttggctcaacgttgggaaatgtagtttttagtaattatttttgctttccatatgtgtgtatatatatatagtacgtgtgtgtgtgtgtgtgtgtataatctgcttctaaatttctaagtgtctcggctttgcagaggtaggaaaataattcattcaataaaaaagacatggaaaaaagttggtaaattgcaaaaatattggagaaggtgaaagggaatgtaaagaacactcgctccctccccccacttgtgaattgtcaactaattgccaccggtggtccgcctagagcccctctcacagctcaggacgcactgagctccggctgggttgtcactctctggattcatttgctttgttctcttcaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagagcagtctggtagcatcctagggcttgtgaggaaccccacccccatgtcccaccccagccctccaaggagacagacttgcctccatgcaaaaaggcaataatccagtaactagcgtctgaatgcctcttagagctctcctcctcctccaggttctaggtgggctgcgagggatgacaggtgcccaggtgccctccctgcgtggctcagactcagcaccctccctctgaactgcctgagaaaatgaaag

SEQ ID NO: 8848 - DNA, 2555 bp, Homo sapiens
ggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgtttt

SEQ ID NO: 8849 - DNA, 2000 bp, Homo sapiens
atgctgaattattctaaatgttaactcttaaaaatgtgtccctgccttttagaaccccacagtccagtaactgataagatctacttgtatgatattctaaggaggatacttgtgtatactttatctcttcaataggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataa

SEQ ID NO: 8850 - DNA, 1099 bp, Homo sapiens
agagtgaaactccatctcaaaaaaaaaaaaaaacaaaaaaacaaaaaactgtcacctctgtaactgctctatttctgtgtttctttcgttagtttgcctcgtcctgtcctcctttcatagatctctgaggcattcagtccctggttccagaagttaccccttcatcagggtcccattagtaatgttgagctgggtctctggtcttagctctgattgtagagaataatatgactttttaataagttgtatgtatcgtaaactgaaacaagctatacatcaccaggctcaaacccaaaaaccttataggcaatctgaaaaacactggaaatcttctttccttatataactcagtgaagatattgcccatgagtctacttgtgtatctgtattcatttctagaaacactcatccatttaatactagctataatttttttatcttttataaatcgaatatatccaatctagtttgttctttgaccttcatgatcagaatgagttcggaggtttgccagctttgcctggaggccttgacaccgttagctgaacagtgtgcaaaagcacaagaaacagactcaccactttttctagcaacacggcactttcttaaggtaagatgtctgtgcggtaggtcagaaaatcagctactttcaaaagtgtggtcggtgcacataattctgcattcaaatgaggaaatgcttccattctttcgggggcaaggaaaccatgacttcctgttcactgtttttttctggagatcagctcttcatggacacattctcatcctctattttttgtgttcttggaaattgatgtggtacacattgagggaatttgatattgttgattattcagataccacagcaagtagcaatatctgtaaggtattttttttaaaacattaaggaaaatttcagattgatttaataaatagaataacaaccaaccctctcttcttcttttttggactggggagggactggaggatatatgatcatcctatgtttttatttagaagtcttatgtaatttcagctggtttttgatatgctggttttgcaaaagcacaacacagagatgaccactgcggctggcgaagct

SEQ ID NO: 8851 - DNA, 1187 bp, Homo sapiens
agaatcaagtttactaggaaatattggatttaaacaaggctcaatattcaaaactttctaaataattcccagatcttgtactgtaacatgaccatgatataaaaacacaaactatactaaccagggtagttttaagtagtgatgctaagtagtacatgctaaaagagtttggcatgtactctgaagatttaatttgatgtatttctcctgaaaatctgaaaattttgaatctgaaaattctctttagctagtaatgctgatattcacacatgtggttacaacttcagcagaaggacatctctagtgttgactcttcctttccttatcttgtctcctgcttcgtgaaagatcagaaataatatgggacagttgtctaaaactctgtagatgaaatgttcaagtatagcctgacctaaatccagagaactgaaagacaaaaaaggacttttaaggaaaaaaatatgattagacagcaactaaataaataaaagaataaatgacttctgttttatacctacaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcaggtcagaatgtaaaacttaaaacttcatttggatttatgatgatagcagttatagaagcaggaacatttttcttggtggtttttcatcaaaatagaactgtttaagagcagtttaacattttctgtgtggaagagaattatgtgactggaatgctgttttaatgtgtttttgagcacatcccttgatatcgtttattttaactgctgttgaagatacagattattatttgggaatagattatgcttttttgtatttggtttaatactatgttaattttttaatactatgggaataatagaagttgacgggaaaatcacactggaaaatgtgagtggattgaggatgtctttttttttgaccagtggaaatgagtacatgtgtaaagttgatgtgaagtaagcactacttcagattagatactaatttcagttcgatttttctctgttttttttttcttgagttgatctttcttgcttaccttaaaaaatttgtttcctctcttaagat

SEQ ID NO: 8852 - DNA, 1117 bp, Homo sapiens
ttggagatgggtcatcctgctgaaagcttaatacttaaaaatgaaatattttaacagcatggctcatcacaggtagtaatgttcaatgactagtttattaaaatgtttttcagatacaaagttctgttttgcacagggtgagaatcttaggaaattttctgattgctttatatttttatttttattttttttaaagctgtgttattttttagttcttcatgctttggaagtaacagttgaagagaggtgaggaaagtttgtgaaaattgtgatcggtgattagctgccacctgcctgaggtgtcttctgagaggaactaacctctttgtggtgctagagcaaggtcactggataaaaaaaagaacaggtaaccatcttattccttgtctgaaaagttctgttttaaaattaataaatgcaaaatgtgcaaggtaaaatgaattattgtttaaataaagtttttaattttctcctcagaaactagtaaagtggactatgtcctctttcaagctgccacagccataatggaagcagttgtccgagagtggattctcttggaaaaaggtagcatcgagtctctgcgaacattccttttaacctatgtcttacaaaggcccaagtaagtacatggagggggactgctgaaatacttttgctgagcttatgtgtatctttttagagctttttttgtttgcattttaaaaacttttgggtgggtatagtggctcacacctataatctccactttgggaggctgagagggaggatctccttgagcccaggagtttgagatcagtctgggcaacatagtgagaccccatctctactaagtacaaaaaaagaaaaaaaatttaaaaagctctagatgtttaaggttaagttttgtgtggggctcatattttaaacacttgtatacacgtgattgtaggtagttttggtgcttaatgaaataataccttttatttaagcttttggtactatgttttgtttctttgaaaaggttgtgttggatattagttttttgttgttgttgttgagttgtgaagaacttagttataaataaaagttgaccttagattagatgaagaacctttatatttacttgttcttttgatgc

SEQ ID NO: 8853 - DNA, 1211 bp, Homo sapiens
tcttcctgttttttccactgcaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgggcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcg

SEQ ID NO: 8854 - DNA, 1347 bp, Homo sapiens
tcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaacttt

SEQ ID NO: 8855 - DNA, 1100 bp, Homo sapiens
ctctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacat

SEQ ID NO: 8856 - DNA, 1101 bp, Homo sapiens
cacagtatagaagaaagaagctttaaatgtttgaataaggttgaaagcccacaaaagaattgttgttaatacattatgattgctatgggttacggtatcatcttttaagtactctgcagttattgggtgactacgaattgttatgaaaatatttattttatcctgagattacatgggtagctggatatttggatactattgaatgagtttcttgtccatatgctattattatatccatgtatactactagtaaaagttatgcataataattctttaccattgaaatttagcagatttaacttgtaagacattatttctaaagcttcctttctgttgctgttttaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaatt

SEQ ID NO: 8857 - DNA, 1186 bp, Homo sapiens
ctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcc

SEQ ID NO: 8858 - DNA, 1218 bp, Homo sapiens
taagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagaccca

SEQ ID NO: 8859 - DNA, 1113 bp, Homo sapiens
gactgtactagattataaaagtgttatggagataacaatcagaagcagtatataatcttggtttgtaatgggtttggatcagttaaggaaaactaaatgtgagctagaaatactagtaggaacagttactgaaatagaacaagtgagaaatgatagaaaaatgtaagtgattgtatgtgtggtaaagtctagttttggtaaaaacatatacagtgagtgtgtgtatgtatggaaaaatatcttgaagaatatatacactaagttgtctagcagaatgtgactttatttttatgtctatactaattttctatactggttctgcaataaaattttgtaaaataaattacgtaacacaattgatagatttacattcaattcaagttttaatgtttcataatttcaatgacagtgcttgtaattcattcaacacttacattttaagtttctgtgaaatgacagtgctttatccctttatttactagatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggtaggagaatgcatgctgtttctacagggagatgtcatacttcaaaactaatatcatttgagttggtaccaattcaatcttggaagtaatgttatttgatcttatcatttgctctgccatctgtctttagaaaagctagtgataatgttgaaaggtgaatctatcttctgatattttgtttgacttgactagaacttaaccattgggaatcttgctggaaaagttgtatagatagaacaaagcaacagaaattaattattcaaaaaccggtgaactctagtttgatgttgactgtttgtctgtcccatgctattttgattgtcaaggtacaaattaaaggtgagtcctttgtgtcctctctgcttcccttcaattttaatatattcttctttcctgggaattattgactgaactgctagttttctcgatatattttttctactttttctacatcctccttaagtaattgattcaact

SEQ ID NO: 8860 - DNA, 1764 bp, Homo sapiens
aaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaaaaaagaaaaatcatcaattttactaatagtctttctttacattttctattattct

SEQ ID NO: 8861 - DNA, 2269 bp, Homo sapiens
agactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaataagtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatatatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattacttcatatatgatttaaaggtaattaaatgttcacattttactttgaatgtttttcttctggataaaacaaatggaatcaagttgtagttgttttttttttcttctcacctaggcaagtagacttgcccattacattaacataacagcataaggtttgaggagtttattttccaaaagtttgttgataaataatacctgtttcatacaaaaataatttccagaatatttaaaataggtatagtgggctaaaaggcccatcagatgtaggtaataatgtcattaagttttcattttgttcctgtcacttgcttatattacaatcactatttttttgtgcccttgccaac

SEQ ID NO: 8862 - DNA, 1369 bp, Homo sapiens
agcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaaaaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcattgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagcc

SEQ ID NO: 8863 - DNA, 1123 bp, Homo sapiens
tggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaataaaacattgtcttgttttttatctacttattgtatatatcatttatatttcatatgagaaatcatgcctagttttttgggtacttactcttatgaaataacatgatagttttgccatgttagtgtcagtctctcttgatcaattgagacttgactctaacactaaggagctcgattaaaaaaagtaaaaaccatttactgattataccaactagttttatcagaaaacaagtgaggagatctaaaataattctagaagtaaatctaaaggaatgataatttatgatacattaaagatttcaaattatttagtagattaaactaacgtctttcattgcggtaagcctctt

SEQ ID NO: 8864 - DNA, 1552 bp, Homo sapiens
gtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcatgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttata

SEQ ID NO: 8865 - DNA, 1571 bp, Homo sapiens
cctttcttccttgaaacataatgacacttcagtcacatattgggattgagcttcccctagaagcacctgaatcacacttttccctcatctcctttccagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaacatggagtcagctgtcttttttatatgtacaaagggtttttgttttaattttaaaatatgccttaataagtagcctctgaagaaatctcttcacttttcatgaagaatatctatgtgtctgtctccataatagagtactgacttgagtcttagatatggatccttttttcctgctatactcggtaccat

SEQ ID NO: 8866 - DNA, 1105 bp, Homo sapiens
agcaggtaagtttttatcttgcttaattttgtgttaaactatttacaggattcacttattccgtaatcttttagaaattgggaacagaatgttttgaattattttctttgaaagataattgtacgttaagaagtcagtcaaaattgtgtggtggcgggaaataatttctctttatggtgtttccaggttgttcacccatgtaatatagatctgaaagaccttgtttaggtttaaaacaagttacaagcatattcaagtgaaagtttttttactttaatgaaaacgatggtaagcaactcttaacagttgtagcagggtaactttttgttgattctgttttgttggttctgttgggtaagaggagtgcactgctttagagtttctgtaacattagggtaatcgaaatgcgaatgtgtcttgtctgttcatcaggcatgggccttgtgcattataactgcatttaaccagctgttttcctttcccttctgtcttggcatgctctctttcctttcctggacatcaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcaatagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatgacttaagtttttactttaataatcatttaattctttctcttagcatggaatgttgaatttcctttgccacttggtatctaaaaatgattggcaggtggtaaagtaactaa

SEQ ID NO: 8867 - DNA, 2361 bp, Homo sapiens
tcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaac

SEQ ID NO: 8868 - DNA, 1932 bp, Homo sapiens
aaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacagatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatac

SEQ ID NO: 8869 - DNA, 1948 bp, Homo sapiens
ttggagttaacagctagtggaaattgggtggtagggtgggaaattatgagtttatcaagttggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttgcagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaatgtttctcttcattgagtagaagtgtggtgtcctctcccccaaagaaatatttaaagcaaattttggttgtgtcctaattcattatgtaatgtccttgctattcaaatttaatgtatttcttgctgaaggacatgaggtagcttattgtgcaacaaattactcagaaaatggcgaggtattatatatgaaatacttgtactggtttgaagatagtccttctaaatcatcaaggaagaaataaaatattttttttttgag

SEQ ID NO: 8870 - DNA, 1948 bp, Homo sapiens; identical to SEQ ID NO: 8869

SEQ ID NO: 8871 - DNA, 1948 bp, Homo sapiens; identical to SEQ ID NO: 8869

SEQ ID NO: 8872 - DNA, 1948 bp, Homo sapiens; identical to SEQ ID NO: 8869

SEQ ID NO: 8873 - DNA, 1528 bp, Homo sapiens
ctgcactagttcccatgttgaaggagcagaggaacaaagtcactctgaccgttatttgttggcctggcagccttgtatagattttggaaattggtttcaaatcttgcatcttccttttttagatttttgaaagaaaaccctttggtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccgagtagctgggactacaggcgtgtgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattt

SEQ ID NO: 8874 - DNA, 1288 bp, Homo sapiens
aatggagcagggaaaaactggaggcaataaattaaatatttattgatagagtttgtggaggcaggaaaatgagaggcgaataattctgtgtagctggagtagattaataataatgtgttgcaatgtgatatagtaaatgagaaaaagctagttacaaaacaatattcagtatgatctcatttttataaaaaatatgtgtgtagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaactagtttgactggtttctgttccatgcaaccaaatggtccttgaggatgactttttttctaattaagccagcattgaaaatgaggaaactgagaatatcagaggcctagacaagaactgtgatcatgggaattaaaagaagtatatatccatgtctgtagttggagtggtgggggtaagggaagagacaaaaaccatgaccccagttagattgttgtttaaaaacagaaggaaagaagattggggtggggacttggcttcttgctaaactttttggcttttaaagaattgcatcatttgctgtgattggtagacttggcaagggtgggaataatttggaagaagtgtgagaattctggttttacatgagagttttagggagtaaggctccatctttgaggcatttacaggaaagataccagtttactgcttgaattttgggatatacttagtcatgatctaagtaaggtaagatgttttgattatattacagaaggagaaaattgggatg

SEQ ID NO: 8875 - DNA, 2680 bp, Homo sapiens
agggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgtccttttcttgcacgtgttcatataacaagatgatgattatcttatgattggattttaaaagattggttatttcctctgtattttggaggaatttttgtatttggatgaaatggcagcagatttattcattaatttatcaggtagtccttaagtcttatctactgtgtccttggatctgttctaggcactaagacagatacagggacttggtatttacagaatgtatagttatacccaaacatcttaatacaatacatgactaacaatgtagtt

SEQ ID NO: 8876 - DNA, 1276 bp, Homo sapiens
aaccctgtaagacttatcatccccacgtggcagataaagacatggaggttcatgaaaatttaacgatttgcccaagtcccccctcccctccccaggaaaagccagcgaccacattccaaccctccgctaactctgcattgagcactctctttcctatgccctccacctgcgcccattcccctcttctgcgggccgaccgggatcctgctgggggctacagcccaaacatgttacttttccaactgttgttttatgtgtttctatgagaaaggatattcggattcagaaatgctttgcaactccagagctgttgagcctgcggcgcggcccaccactcaacagcggtgctgagtggctgctcggtcgcgcgggatccactccgggcctccgagggtgggtgcacgatccactagccactctccaggggagagtgacgtccgggtggaccaatcgccgctggggcaccgaccgctgggcccaatcgcaggagagccgggtagaacagtgacagcgccgcggcagccgaccccgcctcctcggcggacagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgaggtccgcagggccgcggggaagccgagggctgccggagaaccctgcaggtgtcactcgggacgcggaagtgcgcttgccgaggtttgctttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtggggtgagttaaaaataaggccctttcgattgggagctgctttttaaaacgccccctccctgtccgtttttaatacgcagcaaaataacaataacaattgtgcaactgtcgcttcccaaaaggaacctcattgttgaacttacgaaaaatcagttggcaatatacagtgtgggaactgtactgtgatcattggctaaccaagatgggtgacagtttatgatttcaaagactcaaaggcggcttgagtcctacaatgtcctact

SEQ ID NO: 8877 - DNA, 1191 bp, Homo sapiens
agcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccatgtgcatggtgtgatctcaagaatcctagtgggtctctcctgggacccaggcctggaagtgccccatggagagttccagatcccgctctgcttccccacagcccgtgactttagtcctatcttctcactttcctgtagccatttggggaaaatccttattccaacaatttgagcctcaaccagagaatcccttgagcccccattttggatctctgatactgtctgcagatttatttggctttggggccacagaggtcttccttccaaccaagctgttgggataaagcagctcagaggctgccagttgtcaggcatttgctgaaggacttggtctctggcaacaaaacgccctcacctgttgccgccccagtctgtgctggcctgcacatacactatcctgttagagggagcagagtgcatgcagggcggaggggctgtcggggagtgtagctatcctggtaattgttactatctcactccctcaactcccttg

SEQ ID NO: 8878 - DNA, 1112 bp, Homo sapiens
tcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgt

SEQ ID NO: 8879 - DNA, 2282 bp, Homo sapiens
aaaatgcaaacatttttaaaaactcaaaactactacttcctacacttgattgcctagcccattttcccctccagttctagaatttttataaacgaggctcttcttcgttttccctaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcattaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatacagaacaatattccatataaataagtttagcctttataaaaatgaagttgcaggctgacattacattctgtactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataatt

SEQ ID NO: 8880 - DNA, 1430 bp, Homo sapiens
gaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgacttactgttagagtctgtcatatggttagaatttttacttccgctacccctgccatttcttctgctagctacttcataatatcttgagctttactgaggaatattctcacgctctgtggtatttgaatcattttgccaggtcatttctctgtctttagtattttttgctggtgcttcttacatttaatatggaaaggtgggaagaatattactgcattagatgtaattcttcattctagacttccaagtttgttttcacttttttgtgtgtgcgtgaaggagtctgtgtcacccaggctgtgtagtgcagtggttgatcttggctcactgcaacctctgcctcctagattcaagcaattctcctgtctcagcctcccaagtagctgggattacaggtgcgcaccaccatgcctggctgtgttttcacttttctttcaacatgttcaaccagatatatagccattatttttctcagctccagcattgtttgatttttcttgagtttgattttagtatttgagataaatacttttacattctaaacaagtccactctctgtggctaacgcaaaacaaatgaaatctttattgttttccaaacagctagtttaacaaaacagcatcatacatagtgaatgatgttcattggaaaattctaaaatttgtccttgtctaggttgagaacttttacacacactaagataaagatagaaatctgacatgctcactcaattcagcaggaattacacattagaaagaagccagaaaaataaatggcatatatccaatcacaagtaaatgatcctggcgttagtttttatgattacatgtgtctcattaggcaatttatgctttaatggtcaagcttttaaaaatttgtatttgataacatcctgaattctcagtttcgaatagtgcctactggt

SEQ ID NO: 8881 - DNA, 1209 bp, Homo sapiens
tgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataaggga

SEQ ID NO: 8882 - DNA, 1106 bp, Homo sapiens
tttaataagtagtatttttcccaactggtgaagtattaatgttggtagttgaaaacaataggaatgtatggaatatatggttcactggttcttttgttcctgtcaaatagtggcacaatggatctggggtttttctcagtataatgctggcatatttgtttcaaattgtacatagactctaaaaagttaggctttcaaattctggtcaatatagtttgctttaaatagtagctgcctctactacaagttttatttaatttgttgacaaatgagtctgctatgaaaaccggtcctgttgccagtcactaccctctgttcacaaatttgctgggtttataaatataggtatcattttcacttcaagattataattttagaatatgtttattctaggacatatagccctcaaaatctgcttactatatacgtcttataaaatagcatggttcttttttatagtaaatagaatttttatttaattgtctattgactttttttttccagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaagttagtgaacttattttttgcctgagtgcaaagttttttttttttctctatttttgagacttaaattcaattttgatgttaccagttaacttctaaaaaattgtgtcttccacggaaatcttacagtaatggcgaaagattgttttaatgtgtttacctttctgtgttttattgatacatgaaagtggaaataaaacatagaccttatgatttactgttctttgaaaatatggtacataaattctcccgggtaattgatgttacttttttccttgcaaataaaattgatactattcttaacacataaaatttaatatttaaaactataacataattctttttggaataatagctgtatttaaaggcttatatgcatttcttttgtttgccatgtttaaaataccttgtcaggatacttgtaattgaaaattataa

SEQ ID NO: 8883 - DNA, 1521 bp, Homo sapiens
tcctaacacatcctggaagaatattaatactctattttggtcagaatgtaaactgtggtttggggcaagtgtaatgagaaaatgtaattattttatgtgtaattggagttggtagaaaaatagtgggttgagtatgtggagaagcagttgaaaatgaactggatggatctgagttaatctgataactagtttttgttttctttaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacgtacttaaaa

SEQ ID NO: 8884 - DNA, 1213 bp, Homo sapiens
cttacattgtgttaaggataaaacttcaaggatctaactgcatattaccctttttttttttttacccattgctcctttagggccatctcacactgcagatagttacctaaaatgcacatccacttgtttcattctcttgcgtaaaattcctcaaggttaccactgctgttaggatgaagtccaaactctttaatatgaagtacaagagatgcaaattctggccactgcttccatccccagcctcttttccagccctccttccccttgtgtttcaacaaattcagccactttcagatcctcatggtccttcacatttgcaattctagtgtaagtactgtatactctacctgcacagtttcacccaaccagtttctaccttggctttgggggtcaacttgacatcccctcttccaggaagttttcttgatgccagtgtttgggttgggtcctttctgcatccttctcataacacctggacttttccctatcatagcacttatcacactatattgtcattgtctgtttacttctccgtatctcccacttgccagtgacccaggaatgatatcagtcttgttaaccattgtatacctagtacctatcacaatgccaggcacacagtgtgcattcaataaatatttattcaattgactcaaatcacactgaatggaattaactcctggtataccttgtgtgctctggcttctcccagactctgtctgtggcattctccctcacctcccaacatacagacacacataccacacacacaccctgcatttctgttatgccttttcttccattcttccgctggttaaaggccaaatcctaggcttctatcttcttcctctgacctcctttagttttccttgatgccacctccttgacctcagggatgcattatagtaactttatgtttgtatgaaaactctctgaaaagcagagactatctcagttgcttccttgcgtggctcatttgtctaggaggggggaaattgcgcaaagtaggtatcccatcaacatctagtggttaattaactgatttgctatgaagctgtgtcaactctgtggagcctatctgattctggctccaagaaagaattagttggtagatagagattgccaaagggaaaggtctttatactgatttttataacaatctgaactcctagctgggggaaaatgcaggtatggcttatcttagtgtgtcatt

SEQ ID NO: 8885 - DNA, 1160 bp, Homo sapiens
agaaagtggcatttctaaagaatgatttccctcctgcagtgtttctcagtggacttgaaaggactggcttttggtgacacatgttggcatcctattaaacttatttatttttatacccagctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattggtaaagccagcctcgttcaccctgtctcaattctgatggtgactgtgttcatcatttggtacaataagataatatgaacttactgcttttaacaattctgcttaaaaatggttccttgggagtagtttattttttctcataaaattctatataatgtaaatctcaatgatctgtattatagaaaatatttttaaggcagtagcataaaaggggccaaaattatttttaagatattagcgatttctttttagctttccagatcaaactgcaggtgctgttagtttattccattgctctcgtacagaaaaaaaaaatttttttttcttaactcctaaatcttttatttttttctttgcttttctgctttttgttcttcttggaaattctgttggtttcctcttgttttgaattaacccaaatcaacaaaccaga

SEQ ID NO: 8886 - DNA, 1134 bp, Homo sapiens
cgaactcctgggctcaagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgta

SEQ ID NO: 8887 - DNA, 1133 bp, Homo sapiens
tttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcggtaagtaaaggataccaactgaatacttggtaattcattatttaaaaattataaatgatatttgtcgccggctgcagtgactcatgcatgtaatcccaacactttgggaggccagggtggaccagtcacttgagctcaggagtttgagaccagcctgggcaacatagtgagaccctgtctctaaaaaatgaaataaaaatgttagaactataatgatacttgtaatcactgacaagtgcttttatgtttctagtagaagaaaatctttaatttgctacacttgagaatagcatctgacagtgtaactatttaaaaatcttttctgatagaagaaaggagaattggcatatgtttatatttagattctgctaagggctttaaaaatagataacactacgtataattatggcagtgatgaaagcaaatgctacttgagaactgtcctggcctacccttttgagtcagctgttcaaggaaagttggactcagt

SEQ ID NO: 8888 - DNA, 1144 bp, Homo sapiens
ttcctgttgtatcctttgacttacctgtgctctgaaatgtgtttgagtaatctgcttttttacagctgcccaaaactcctttgtccctccccgcctatgggatgcccatcgctgcccacactagaacatagttcattctcttaggatattttgtgttttttggacctgaagtggaacagcttgtatttgtacttaactgaattgattttgggactagatctagagtgactctatctaataagcatttattgaccatttctgtgtggtttacattatgttatgaacaaaataggaagagaatataattatccttacgtggatggaatcttagatccagtaggccagttagtcctaaaaaaagaaaagtggttttgccttctctcttttattccaattgagtcttagttttttcattcatttactcaagtagcattttgaatacaggtaatattttgcttttcatagttagagatatataatatagatattgtttatgtttttcagaatttaaacaagcaagcatatgatttggcaaaggctttactgaagaggacagctcaagctattgagccatatattaccaatgtaagtcttacttgtaattggttgtcagaaggattaaactgaaaatttaaagacttgctagaagcaaaatttcatcagatagtatatagttttaaaaacaacaaatttgtgttgttttaacccttaagtaatatattttctttctccttcttaaaattattcttgctttatattttttggaaggcttgctctcatcctatttgttcttttatcttctttcaaattgcctgagaacttaaacagttttattttggttagcaagatattctgtttgtttctactgatagaaatagagttaaatgtaattagataaaacatatggaacttttcattattcagagacgttgcttacaggtttttggagcttaaattgatttgtacaagaagaagatatgaactaatattaagacctagaaattgaaggcaagtatgaatggcagtagtgatttagtaaaagttgcttatctattgctattcctggggtagattccatataaatctatcttttctggaaaaaaggaacaattgtaataaaatgagacctttcagtatcacccca

SEQ ID NO: 8889 - DNA, 1190 bp, Homo sapiens
ctacatgtaaattaaaaccctcttttatattcctattgttaatattgacattttttgaactaaagttttatgctttcattagtgcttgtcagcaaatgataatatgtttgaattttaggttattttactgtattgataattgttaagatccaaactcagtaactgctttcccagaaagataatgtaagttcataaatgtgaaatgttttcatttaccacaggaaacataagtagaaagatgattaatctgtttgagttatttttcttgctgtagacattgacttctgttcatttctctttaaaattattagatagaaaagtaaaataatttttttctttcactgttctggggaagtctgtgagcctgtaagggatcaaatgttatagaggtctaaatatgtgatgccagggcagaaagtaaggataaaaagtttcagggaaaggaaagcaaagaaaatcaggaacaaatgagaataaagattagttaaaaatgattactgcatatcttatgcacatatacccattttaattaagcatctggtgactttccttttaaggtacggcggcgaagtgctaaaagggaacggcgatgaacaaatgtaattaataactttctctgtgaaagctttggaaaaatctttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaag

SEQ ID NO: 8890 - DNA, 1325 bp, Homo sapiens
cattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaatacagttgtattattttgtgtatgtaaatcaacatatatatttaaatactaaatggagaaaggcacatttgatgatttttaattttggagcctttgtttcatgaagtggaaacacgtctcagtaactttttccaaaccttttgtttaaacttctcatgcaaaatgttggcggacagagaattctaagtattatttaagttgaataattgcgtaactgaacaaaataaatgtataatataaactttaaaaataagcactaaataaataag

SEQ ID NO: 8891 - DNA, 1204 bp, Homo sapiens
gatgccaatatatagaaagtgtttttccctttaaaccatctttactttgaacaagtaggtattacgaattctactaaactaggtaagggctagttatttactgtcttctttctcaagctgatttagttggctataagaggaggctggaatattgaggaaacagattttgcaaagagatgatgtgggaatacctagtccctaggaagggaattaaagttagtatgaaataacattaatatgaatatatatacatagatatatttttttctccattcttaacagccatcagcaaaaattatgattcctcacattaaatatctttccagcttttaatagattttgggagatttcatgcaaagtagggataatatgcaacattgtgttagatgcagagtggtaagttacttttagtgtaagtttcacttataagaattttgagagtaatacagttataagggtctaggaggatatcaacagaaatgaatcttaatctgctttttaatggattgcccatttttgttaattttatttgtagatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacagtgagtggaaggggtagttacattctaggactttggcccccaagctttttggcaccagggaccagttttgtggaagacaatttttccatggactgggcaggggtgggggatggtttcaggatgaaattgttccacctcagattattaagcattagattttcatttggagcgtagatcccttgcataagcagttcacaatacggttcacgctcctatcagaagctaataacatcactggtccgacaggaggtggaactcaggccataatgctggcctatccgctgctcactcctgctgtgcagcccggttcctaaccgcacggaccagtggttggggactcctgttttaggacataagcacacttctgtttaacttcttgtgttctctttttgtcatgtagatatccttttactgcagatcaagaaatccctgagacagattgggaggtgtatctgagggagactgcaaatgctattgtcagtcagcaaactccacaaaggtaccagtataaaatgatgacagtaaagctttc

SEQ ID NO: 8892 - DNA, 1151 bp, Homo sapiens
tgagggttcactaaggtctgggtaggggaggatcgtgaattcatttgttcaacacatctatgtagcacagcctttctgctaacctccccacttgatacttgctgtgttatttcatttaatactcacagcaaccctgcaaagtagatgtaatttgtcccattttatataagggaaactgtcacaagtgtattgggaaacttgcctgaagttatacaaactttagagtctgtgtgtcatcctccaagtccaagttctttccactacagcatggcatacagatatataaaaaattactttagtctacaaaactaagtgctagtaaagtacatacttattgctacatactggtaggatgagggaatgtggcaagggtaacattcatactgccttaggtagatacacagtaaaatagacccaatcaaaaggacttccaaaatgcaagtttgcctgcatgaggttatgtttcattctaccacttctcttcaggagacggtgatgctgagggagctgtagctttaagagaaagaaaaataaattctcatgaaccccaagcatgcacctgtgaatacccaggggcacttgggttttcaagtgaaaatatgcttcacaaactcggaacccatattttatgatagctttcagttgctaattgtcactgaaaaagaaaagtctttaaaacctgaaaaataattcacattcatcttttctttctggtccctgatgagcctactacctacctggcagatacttgataaatggtaaatattttttgaataaatgcttttttgagcagtaagtttttaatatatcatagaaatttaccaggtagacaaggaggagaagttattctagaacataaagtgtggaaatgtttgatatctgcatttgtttttttttaatttcaatagactttacttttttagaacagtttaagtttacagaaaattgaacagctaatacagagagttcctatatatgtgtgtgtattggtcctgtttttttccttcttcaaagaacagagacatgaaagtaacatctgataataacactttatattagaaaattgtcagctgcaagtaacagacactgtaaactggcttcgtaaaaaatagatagatgatagatagatagatagatagatagacagacag

SEQ ID NO: 8893 - DNA, 1519 bp, Homo sapiens
tatcgtaatgttgctaatgatcattagtattccaataggaaggctagggtaaatgaaagcaaagattacaatattatcattttttaattgttgacctatacttactctgggtgggttttgttgaattgttgtgagaaaataattacttttaataagaatatatatttaaaaacctgtaagcttattcacctgaggatttaacatagttttgcaaatcatttcagattgttttaggatatagaaaatacaatcatgacattatgagtaagagtgggtgaggattcaattaatgtgggtttttcccccttctttgcagcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaatccatttttgttttgtttaataaatatatgttttctcttttagtagtactatgtagggaatttaatttcctagagttttgagaagcttaaaaattactgtaggcatagcctaattctcacatcaaattgtacaacttttctttgaggataccaaaatgatggaatctgcagatgtttgacatactttataaaggaacagaagtttccaactaaggctttattcttattattaaaaacaggtgcatgattcttcattctctttcctttaggaataattgctttgacattagaaaagaacctgttgaggtattttggacactgggactactgcctatgttcccagctggtcttaattg

SEQ ID NO: 8894 - DNA, 1519 bp, Homo sapiens; identical to SEQ ID NO: 8893

SEQ ID NO: 8895 - DNA, 1206 bp, Homo sapiens
gtgagagcactcagagatgagagctggtcaactcttcttcatttatggagaatgaaggtacgtgctagagagtatgtttttcttcttcccaaacattatagtcctcataatccttccgtgggaaggaagttctttaaaaggggtcccagggctgtggtgctaaatgactgggaaccagagaccccaggtgtgcgctgtcttacgttgtctctctgtttccccaccccactgggcacatggtgagagactgcacatccctccttcctcacttcactaggggactgcttttttgtagatttcttcccagcccaggcttttattacaagagacaaagggaaagctggttgaccatgagctaaaacatttccacaggtcttcctttataatgttgtgatccaactgtctcattttcctttctcaaaaatcaccttctgaggacagtgattctgagcggaaaaaaagcatcaaaatccccatgtggctttaggtgtcacctgaaatgagagtctgctggcgctgccccgagacaggtcaaggctatgcatttaagatgaagtctctttcttcttttcctcaaaccttatctgtttgggagcaacagcccaagaagcatcatcttgaaacacactcatttgatttcatttccgcagtgcaacctccagcctgtttccacactgtcacaatgcctaaacacatacaggctgggtcaccctgagcattatacagctactgttaaataaaaccaaagagaaagaagatattccagtttttaaaacttcaataaggaaacgagaattaacatccaaattaaaattctttctagcagtgcacatactctgttgtttcagagtatgaaatgaaatttgtgtagctgtgattttaaattaagaagtaccccggaaatggtattaaatcaataatatttggggggaatacttaaggaagaagatatttagttgtgaaatgtcaaataaggacacaaggtttcatttccttgttttctcctattcttccaaggccacttaaaagatcagatgctttgaccaaaccttctgagcctcatttcctataaactctcctgtcaacagttgaggctcatggtggggttttggtctgaaagaaggcaatcttctggaagtaaaaacctactcttagaatatttaccctgtaaaatgatattaacaagaggtctggtagccagctgta

SEQ ID NO: 8896 - DNA, 1109 bp, Homo sapiens
ctcattagttaagtatcaactgcaggcttatatctgtgctttgttttgtcaatacatcctggaaactgacagcttttttgaaactgaaatacatgtggggcaaagcagcataaaatatgtaagtaaacaagacgttctccttgctcacagcagcagccccaaacctgtttctcctggtaggctaaagccctggccgcttgtctgactcaacctccaggaaatgagtaactgcttcctagtgcctctactctgctccaagcagtaggcattcttgctgtttctttaatatactttgttggtgaagctcatggaacagtggtgttcttatgtaagatctaccagtcaattaaatattaaaatacagttgtctacagccaggtgttttcagtgtctcctttacagatgaatggaaaagtcatttatattttgtctttgttttcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatggtaggtttctgactggaatgtatccagtctgtcttatgacccagccatcttctaggtaatgagaaacagccctgtatatttataatgaacatgtagatttaaacaaaattgacaataatgtatgtaaacttgatcttgcctttatacttttcctgagttggatcttattttgaaaatacacaaacccaacaatatggtataaagttatgtgtgttcaccttaattgtagacagtagaaattgagtggcctgaaaacattttttttcctttgaagaaaaaagaaaaagctcagaaacatcaaaacagaatagggcacccattttctcttttcttccttctacggaagataaggtgtctttcctaagaccgatcttttgacctctacatctccttccaccttgtcaaaacctaatcctgtccatgtatttcatctcttgtgtattcagccttttcccttccatcacatctttcccagaaccctttccattgaccctgctgtgcccttccagctctag

SEQ ID NO: 8897 - DNA, 1217 bp, Homo sapiens
ccacaatcaatattagaacatttttcttgcccccaaaagaaattctgtccctattagtggtcactcctcatttcccctcaacctcccagtcctgggcaatcactaaactactttctgttggtatagatttgcctattctggacatttcatataaatagaatcattcaatatgtggcctttggcttctttcattggcataatgttttcaagttccatccatgttgtagttctcaaaaacatctgtgtcttttcagttaggaactcaaactcatgctgttccttcccatagaactttatctgactcccttggaaaaaataataataaataataaaaatatcctgtagcaggtgctatctatgccaggtactatacacataaccttcacaataagctataaaggagatattatgttcactattttccaaattaagaaactaagaaaggtcatactactcattaagtcatacagacaatattctaactcaggtctctgactctaaaccactcttctcctctaccccacatagtaggtctgtcttggaagatgagtcatggttattaccagcattgccataaacacctacatcacatttctctgaaatccagcactggcccatggttgtggctttgacttgcatcagaggagtacagagaagacgctcattcaacaggaaaaagccctcaaacacagactacgctggaggtgaggcagaacgcacagtggtcaagactgcaggactctagagtccaaaagacctggcttcaaaccccaaaccagtcaccctttagttgcatgtactttaggtagttactttcttattcttgattttcccccatataattgaggaggatagtttctacctcatagggctgttatgggaatgaaataaaaggatgaaggcttagcatagtgcctagcacaaagtaagtgctcgacaatatttgcaactcttggttattattactgcattagacaaaggtgaaatggcatcttatcagtcatccaagaagcacgtttatggaccctgcatgtgcacacacacacaaacacaccagtgtagtttgggggtgaactgctcatcctattatcatctctaaagtatcctattcataaggggaaagggtttaagtgtaagaaagaataaagcaggagcagacctacaacatggacaagaagacacccccaaggacctgagtgaatgatctccacggagcc

SEQ ID NO: 8898 - DNA, 2088 bp, Homo sapiens
catgttaagttgaattgattttaatttggctatattttcattgtgtgtgtatgtgtgtgtgcgtatgtatgtgttttttcctaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttt

SEQ ID NO: 8899 - DNA, 1756 bp, Homo sapiens
ctgcctcggcctctcaaagtgctgggattacaagattgagccaccgcacccaacccccttatccctttacttgtactgcttatatataagcccaagcattttcttagataatgcatcctttgtgcaacaggaataaattaatacatagaacttctcccagcatttatccacctgaataagtgttcagtatcttaaataatattgtaaagtcagtattttaaagtagttcctactccaaaatgagcaacttctaatgtcattagaaagctgatcttggggcattggttatatgaaaacgtttgtcttaccctgtcaaatagagttttactttaactctatttccagtgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaataagttaaatattgttattctaattccagtcagaatcaccttagcattggtgagatagtatttggagatttgtctttgcattttttcagtctactttttgggtattttatg

SEQ ID NO: 8900 - DNA, 1248 bp, Homo sapiens
aggtcaggaattcagtgattccatttcttgtcatttagtaaattttagggactattttaatatgatctttaataattattgtaagtagaatggtattagtaggaatagaaaaaaattttcgttaactttttttaacctctactttttttttttcctttttttttttttttttttgagacggagtcttgccgttttgcccatgctggagtgcagtggcgcgatctcggctcactgcaagctccacctcccgggttcacgccattctcttgcctcagcctcccgagtagctggtactacaggtgcccgccaccacgcccagctaattttttttctattttttagtagagacggggtttcaccgtgttagccaggatggtctcgatctcctgaccctctgatccgcccgccttggcctcccaaagttctgggattaacaggcctgagccaccgcccttggcctaacctctacttttatataataatataaaatggatttcacttgtaattaaggtgtaatctgtcagatagccaatgttaatgctaaaatgaaaagtaaattgcatgattttcttgtaattttacagcgctttgaacttcaagattcaggaagctctctacttcctaaagagattgtaaaagtagagaagatgatggaaaaccatgtgtcccaagcttctgtgaccatccggattgcagataaagaggtgaccattaaggtaattaatcacaggtttattctttctatgatataccttattctgcctgtttttatgacctaaattgggtttatgatctccttgtaagtcttctctcttgatagtactgcttctgtcggtatctatatgtctatgtctccagagtcatgtgtgcttataaactggaaaagttcaggagaaacatagggaaagcctttcatcaaaaattcaaagttgacctgtgggaaaatcaagtcacaggctgattactgacagcattttgtgctatgagtccttggtaagaaatagtgttttcaaacatttgagctgctacagagacctattttcaagtaaaatctttcttagctatgtgaaacggtttaaaaaggatctgctctggttgaattgtttttagagagggaaataatatttggtcatagagctccatctgcatgtatatatgttatatatatatcagctccttctatatatatctatatgtgtatatatacacacattttatggagtcttactatattgcccaggcttgttt

SEQ ID NO: 8901 - DNA, 1191 bp, Homo sapiens
taatactttactgcttattcttaaaattaacactgagttttcaccttaatacatctcttaatattttaaattaagtatcattatctatgatttgagaatatggaactgataactccatgacattttgggtaattccgcctttattgtaaattccttatagacttaataccatctttgctataacaaaggaagtaaaatgtatttgttatagaattattgggatggtaaatgagaaagtgtcacaaagccattcctatttaggtcctcctctccttaattctttatgataacatatagatccttggaagtgtcaaaagccttgtactcacaaatgtcattgtttttaattttcattaatgagaagagtaggcactgaaataaggcactgaaaaccttgcttttaaaagtaagatatttgatatcaggcctggatggactggttctttctgtgttttttcttaacatgcgatcccatatgtgtttgcttttctttccaggtttaagagcaggactggctgcctcaattgctgggagttcgattatcaacaaaatgttactggcaaacattgatccttttggtgccacgccgtttattgacccggatctagattccgtgtaagaaaatgcttttgcaaatattttgtttgggtttttcttgttttttttttttttcaacatgaactgtaacattttaaatgtattacaataaatatggtcccatgtaaaaaaaggatgatcagaaaattacaaaagttgataatgccaagcacattgagtcttttaaaattcagtggtctccgtgatctgtccctgagataggtccttttccagcccgttctctctgagagcaaccctctggcaaaggaaggcaccaataaatagaactgatgctattccctttacctcctttcttctcagtcttgccagatctgtcatctttccacgtcagcttctaggtttacttattttgggaatcttttggcccacactgatctcttcccttcttaagactcctacaattttttggcatttcaagatatactttcttttacttcctttttaaattttgcttttgttatatcatttctgtaatgacattcctcaaggagagtaccatattttaaacgttccaaaacacctggaagaatggattggatctagtacttttttgctcaataaatatttgtccat

SEQ ID NO: 8902 - DNA, 1237 bp, Homo sapiens
aaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctggttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgat

SEQ ID NO: 8903 - DNA, 3653 bp, Homo sapiens
gatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggtcttggttttcattctataatatctcattaactgctctgtactgagtgggactgctatgacagaagaccacataagaggactgaagtgctagatcatggttttgagaacaagagaagttagaaatatttccaattggacactagattctacctacttatagataccccaaatgcagacatagtgacttaaaaggctggttgcccaacctgtttttgcaaagtagaata

SEQ ID NO: 8904 - DNA, 1183 bp, Homo sapiens
aaacagatgctatttaaattgatcctgtagcagaagattccatttcaatggaagcactccttctgcccaaccagactgtgtttgttttgtaaattcacacttggagcctaaactgtctttaagcttagcccctttataatcctatttttatgtagcacctatcaatgccatgattcttgacatctctctcatatgtgcacaaactttccataatctggtattttatgtaagattaatctgtgttgctgacattggtgtctacaggaccaaggactttccctaatactcttaactactcaactgtgccacacctcggtgaaattcagctgaggcctagctgaagttcttaaacaatccatacctgtttgatcctagcttagacctgggtggggtctccacaaagtttcctgcatgacagcccagcatgttcccagctcctgtcaggccctggcttcttgcttagtgctatgagtcccttgagcctggtggagggcttgagctgatgggcagttggcagggagaggaggagaatgaggacatgagcaaccaatcttcacaaagggagagccactgacgccttgacctgggaaaggttaagacgcatgaccagggagtagtacagggtcactgcaccgccgcctgtgtgcagcccaaagtgccctgatgcttattgactgccaggaacaccattatctacattacagtttattatgtgttctgggcatttcattccggtaaggtttgatgcaggatcattacataggagagtggatttaatcctgtttctgtagcaggcttgaaggacactgagggaatatttatgtaataagatgcaaagttgctatggaaagtactatagcaacctaacgtcttagcagagccaagcagccacttgtaacagcaatccaaatttacatttattttagtgtcattttatcgacactcttagtatctcattctgacaggatgttaaaatatgttttcagcttgcgtttgagcaaaattaacacagtgttgttggaatttaagtgcggtttgcacaacttctagaaaaaatcaggatattttttgaaggagtttagatgacagaatctgggcaactttgtaagctttttattgttgttgttctttcctaaacacaggagagaattcttcagtagaatttattcctgattttccgttt

SEQ ID NO: 8905 - DNA, 1165 bp, Homo sapiens
aataagggcatgaatgtccaagctaatatttcttttctgctattctggcaaatgtaaattccctgttcagttacaacaagcaaatatagattagccagcccttgtactctgtctctgtgacagatttatcctttataacctcagtcttccacaacgtgtgcacttttggtatagactcagcttgcaagaggcctaccgatctggaatgttcctgtgttaggaagaggagaaaggtaaataataatatagataaagataaataatacaacaccaaacaatcctctgcctccaaaatgtcttttgataaatgcaggaaaaatgactgctattgaaagtgtggctggggcccatggggtagccactctctgacctgggtatgtatttacaaaatgctctgtgcttggctttggggatacagtggcttagctagatagatactttcactgaggaagtccacatactattcagagtatggtcaggcttttttcaggatgatgatataggtactttgtgtgccttgctaataacactgccactttctaacacagctatgtgcccaggtatctgcatcaccacggactgggggcaccttagggccagggatcctgacttacctctatgcccccagcgtcttgcctagcaaacttgtacgtaattaatacatgttgaatgagcaaatatctcagaaggacctagggcagtatgccactctgcttctcagtttttccaactataaaaactggctgaccctaacatggagaatggcatagttctgctgagaaccatggattgcaagcatcgaggatagacacatacatagacactatctctctctctctcactcaccccccgccccgttctttttctccctctgtccctctcacctgtcacacttctgtatacttgttaaaacacagtaatacactgaatatattgaattctctttctggacaaggtgggcacttagcaccattgtagagtctcagaagccaccaaaataggaaaaaatgctgactataatttacatttgtgtattgattgcttgtttgtaaattgctggcacataaacgtccatcatacagtttggcactcataataacaacgtgaagtaaataggcaggttgcagcctcacatctgagatgaggaagctgaacttgacattca

SEQ ID NO: 8906 - DNA, 1192 bp, Homo sapiens
agataaaatgagctcaagtctttatttcttggtgctcttaaagctgtctccagaatgtcttcatagaagaaggaggtttgtgttctcatagccactccagcatgcagttccatttgggctgcctgtgagttcagtccctgttttcccccagttggcccagacatggatctcagggttgttttttttaaatttccaccaacctctctccaagttctgggtatgtgcattttactaagaaatgagtctagggctgggccagctgacatcaaagtcaaggtaaattcaatggaggaaagcaaaccggatgcaccattgttctttcgatagtgtagttagatcttttaattgtattttccctttctgggcaggctgactccattttacaaagactctgtgtcattgtgtgatgctgagttctcagagcagagtgggtgtttaataaattaggtaagaacaaggaggacgctcttcagtctggaagcaaccactcaaatatttgagaccttttgagaaagtttggggaatacgaagaacaacctcttttggtaaaccagggtttaaaatggcattttcttcttgaagctttcactttctcatgtgaaaatgtttcttattgttatcttggtgaagggaatagttttcactgtggaactctagtcacctcccatgggtcagtgggattttgctctctgtgtgcatatatatacatatatatatgtatttaaacgtttgcctgtaacttatctcttcctaccaccccagccacctaccagtattcttcgcaggctctttgtgctgcattcctgagtttgccttggagaaagcagttccaggatcttaggccataagtaaggacattgaatgtttttttcttttccagtgaggaatttctctgggtccagagcgtccccatatccttactgtggctcagtttccttcggtgaagagtggaattgtcaatattccgatggcttaatgccctgaagactctctgatggtcaattttcaggcagtttgtgtaggaaacatggcctggcaatggcctcaggaagcctggctgtgatttccaaagatgctgtgatcagatcgaacacggagataatttcactgctgatggaatagagaaaatatctttctaggaccagaatgggaaaggaacttgtgtcagaccactctaggtgatgggtcagat

SEQ ID NO: 8907 - DNA, 1947 bp, Homo sapiens
gaatatgtaaatagttagggagatccatgtaaaataatgtcttggaaactcaaaagagtccagaaaataccaaataatgagttaaaccttttctgtcttctttccaggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgt

SEQ ID NO: 8908 - DNA, 1259 bp, Homo sapiens
aagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaaaaatgcacttactgataatggcttatttctgtttcaggagtagaaagtgaaaactgcaacagtatttttaaatgtattttaattttctgtgtc

SEQ ID NO: 8909 - DNA, 1112 bp, Homo sapiens
tgccctagagtcagtgtgtcaagtccttactgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcagcttactgcaacctccgcctcctgggttcaagcgattctcctgcctcagtgtcccaagtagctgggactacaggcgtgcaccaccatgctcagctaatttttgtattttttagtagagatggggtttcactatatattgttccaggctggtctcgaactccagacctcaggtgatctacctgcctcggcctcccaaaatgctgggattacaggcatcagccaccatgcctggccaagacacaaatttttaatggaaaaatattctgattcccag

SEQ ID NO: 8910 - DNA, 1160 bp, Homo sapiens
actcaccttagaactgagaattctgaatacctgtcatatgcctgcttgatagaatattctcaaaaatgttgctcattttttttatatgctactgctcctgaaactactggtttcaatctgtgaactgagtcccatgaggccactgaactcaagggcagattacccttggtgtaccgtgtcacactgagtgaggaccagtaattttttcgtgtatttcatgtagtgttttttgtgttttttttgtttgtttgttttagcttttaagttgttggcattcaggactttcaactcctttaatgcacatgatcatatatttagtgcagttaccatgtcgcacatgtagaatcaaaaggcagtttattgaacctccttatagagaaatcttgctgagcttttaggatcataatttttatggcttgcatatgtgctttggcatatcatcttattttaagttttgtcccctgcatttataatctcatttgttaggggttttgtttttgttttaggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtt

SEQ ID NO: 8911 - DNA, 1141 bp, Homo sapiens
cgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaatgatttctggttatttcagataaatagaaacattcaaacaaaggcaaactacatggagtctagaaggctggagtagaaatagtgttgcagctgcagacatttctctctgcatggagaagttgctgggataatcttactcattgcctggcacctgtgtgatccccctaccctccccccccccaacccccctccccatgtatga

SEQ ID NO: 8912 - DNA, 1522 bp, Homo sapiens
gattacaggcgtgagccaccgcgcccgtgaggcagttaattagacactgaagggcagagtgatgaagcaggaatgctggcttttgctgtcctcttgttgctcttcatcagctcctgcctcccaaggaaggatgcatagtggaagcctttgaggagagcttcccagggcttgctaactctctctctctctctctctctcaaaagcttacagtgctggaaagtttttccaccacagcaaagccacaaaagcttatcagcgtagatgccatctcagaagaggctgataccaggggatttacatatctcagctgtgatctttctgctccaagctgaccttggaagatagtttgatgtggttaagggtggaaccccttttatttaatcgtgtccatagcgtgggtctgcctgtacctatttgttattaagtgtgccatttgtaagtctgttgttatgcactggagttgtgaagatggcattttctgtgtcatccttaacccataaccacagttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccc

SEQ ID NO: 8913 - DNA, 1171 bp, Homo sapiens
ttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttgtcctcacgtgtctgatacgtgtgtgcattccttgaggaaaatttctttaattaaaattttaattgagataacttgtgtcagactcacatgcagttttaagaaataatacagatagatcccatgtaccctttgcccagcttccccccaatggtagcatcttgcaaaactatagcacagtatcacagccaggatattgacattaatatactctatcaatcttactcagattttgccagttttacttgtactgtataaatt

SEQ ID NO: 8914 - DNA, 1137 bp, Homo sapiens
tctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataa

SEQ ID NO: 8915 - DNA, 1188 bp, Homo sapiens
tctctttggtagttggagttccaggagcgggatctataaacaggaaggagggtggtggaataggattggggccttagggtctatacagaactgacttggtttccggccatccggttccgctccctgggggagggtttgtgtcatagcaagcgcccaacatttcccagggcagtgggtgctccgttttggagccgctgcccagacctcttggctgtcatcgcctcatggcccagggtcagaccccctgggtcttggatgggttgactctcatcacaggagcacccagtttaatcttgtagtgggcaagggagcaggcagtgggtttttggaggctaggtttccagtgtcttttcccccttttaattcaataaacatttatctagagccttaatgaatatttagatacagttctgagttcactggaggcaaagatggctctccagggtcattaaactttgtaatttggatttagggatagtcaggaatcggcaaaaaagagggaatttccaaagttgagctgtcaacagctggggagtgtctttcaataagacctcttagttacatcttctcaagtggaacttattccaagaattgcctgaatcactgacttaaaaaactacattaaattttacttcccttctgctatagagtgtaccgtgagctagctatgctatggttggctatatctgcagaaaatagagctggcatgactaataataataggtttgtgtagttcagtaagggggcttcatagttgttctacttcagttatgctaaggattatttacaaagttaggtgaacttgatgtgtctgctgtgttggcatttctttgagaagaccagtgcttttagggatcacatcttttagctaagacctcgccatgtgaagtggatgctgaaagtgttcttgttggcttgtttatggcaagcttaagttgtgagttttgcaggtttttatttatgagctcacttgcacatgttttatgctcaggaaaatctaactggttaaaattcagaggctttatgttaattcctcatccaaaaatacagtattatttgggggaagaggagtggagggatattcatgtttgtagaaacttaagtcaaccccatcagaaaagtattcattgcagctagttattttacatgaaattagaatacccaaatgtattaaatatttgcttctgc

SEQ ID NO: 8916 - DNA, 1195 bp, Homo sapiens
gcaatggatgaaatgatgcctgtgtggtgctggttgctttggtccagctgagtttcctgcacacattgtcaggagagggcagttggcaccagcttcccgttgctattggttgtgcaggatgtgctctccatctgcctcctggctggccgagggctcagcttctaagtggcggtggcggggtggcggggtggcggggggactttgatggcattccttgtgttgaataaagttgtctctttgagaactgcccatacccttattttttattttttatttttttttaaaaaaagaaaaacatattttgttttcttacatacttgtcatttgagttgtcacacagaaaatatattggacttcttgtatttgtaaaatgtcttctcagatcactcctttttcctttcttgttaaaaacaggttcacagacagtatgaagtggcctttctgtttacatgtgttcttgttgtattgtctttgcagtcgaaatcagctgtccgccctgcctgcctgcctgtgtggtctgcctctcaaagtcttaatcgcaagtaacaacaaacttggatcattaccagaagagataggtcagctcaaacagttaatggagctggtatgttaccgatttttaagatgctcttttttgttggttgactgatcatagcctctcaaggtattcagaaaacctttttgctacggttggacaaggtagagcctctgttgtttgagggcaggtatatgataaagacattaagtggggagaggaacagctttgaaacttcactgtgacagacacagttcctggaatttaaaggcttcctgtaatttacagctcctgaagtttgcaggatttgccgtttttgaagtttatgggctatcatgttgtagttagtattttcagattgcatataaatttgtaaaaaattatggctaaactgccaaaataatctccaaataagttagtaggccacacttcatgaaggtataaaattaagtcagaagacagaaagaatggggtgctctgattctgtcgagattttagaaatcattgtcgcaaatcgttgtaattttaaaatgtgaccgtgtccctagggatagaaaaggagaacaagctatagatgagcagagatggattacaaatgtgtgtgaagctgagatgcactgttatatttcagctctttcactactaatttaattatttacc

SEQ ID NO: 8917 - DNA, 1356 bp, Homo sapiens
tgatttttattaatttggctaaatgtgtatttttttcctagtcttaaaaaaattggcacaatagcttatgcctgtaatcccaacactttgggaggctgaggtagcaggatagcttgagcccaggagttggagaccagcctggttaacatagtgagacctcatctctacaaaaactttaaaaagtactcaagcatggtggcacatacctgtaacccagttactcaggaggctgaggcaggaggattgcttgagcctaggtcagggcttcagtgatgtattcgtgccactgcactcaagcctgggtgacagaatgagaccctgtgtcaaaaaaagaagagaaaaaagtaaaattaaaaaaaatacttcaaattgttgcataaagggaaaagtaagaactagattaattacagatagagctgttcttatctatgcttctttttttctccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaa

SEQ ID NO: 8918 - DNA, 1650 bp, Homo sapiens
attgcaagggatacaccaacatcagctggaccaaactccttcaataaaggaaagcatgggttttctgataaccagaagctatgggagtggaatataaaatctcatcttcgaaatgtctatgaccaagacaattaaatgatgttttgaaattggggtgtgggtgggtataaagttaaaaagaacagtttcctttttttaagaatggtataagactacctttggagccactttttttttctttttcatctttttaaaagattgagtggtacaccaataaatgagagtttgaaattagaggtaatttatgttttgtatacagatttcaagacatttgctaatttggtagttttgtgtgattagtttccaaagtttacagataataaagaaatcagaaatggtacctttttaagaattgcctatttttttagacacaactattagcacattaagagggaagcaaaaagttaattgtctatttaaaactgcaagcagttactctcttaactcccttattacctaaacttgtctggctcccaggaatagccttatagagagagggagtattgtattgggaggaaaatgttactgaactattgactgaaagtacatttagataaaattaaaatacagcttttttcttcatgggcatttgttttctttcaagtcatcataaactaggtgttgcattgctatcagtggatacagacgcttagctcttaaaataacttttttatatgtaaactgttgaatatttgaaatagcccacttcaccttaatgggtcttgtctatcttcattaatcttcaaagaaaaaccatttgctaccaaagtaaatcagtattttgaatgtgcttctcttgttttttgtttattagctagttcctgtaagcatttccaccagaacttgaagcgaatcataagaaaactgtttcttttaaaatacaaaccaccaccaaaaatttaaatgtacatattgcttaagtatttggctgcttttattttttaaaaggtataaacaccaaaaaaaaaaaatttaacattgtatgaagatggaaaacaagaagatgcactttctgtaactttgtccaaggatttaaattactaacttgtgaaatccaatttgaattgaacttaactactggctttcttactagtaaaattatatggtttattttaaatgtatacatattgaccaatggcctctcaaaaagcacattttagatactgaaatagaaggaaagaaaatgcatcttcaaacattttttggaatctcaccacacatactttgtgaatttgtgtattgtagggtgttttctttttgtatttttgtattgtatacgaactttttttttaatgtgacagttaaacacatctttaaaagcacagtcacagacaaaaaaaaatacagtataaaaatttccttgaaaactcctactacaatattgtatttggaggcagcttcagaccgttttattggtggtaactgctcgctgagctcttttagtcggtaataactcagagaagcaacctgtgtatattcctaactctttgttaactagtatttaagtttagaataagccccaggtaaaacaatggaaatgtatatagaactcttagttcttatatgatttaattatatcaagatacttga

SEQ ID NO: 8919 - DNA, 1751 bp, Homo sapiens
acatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatccattcctagcctttaaggggctctatatgctagagatttccaaatttatttcttcagccctgatcttttcacagaggtcaaggcttttatagccaacagaactcttgattcctactcccctctacccaatgtctccaaatataaactaaaatcaaataaataaaaatcttttttttctaccctggtctttctccattttattaaacatttatcaagtcaaaaacttaggagctatctattaattcttgtctg

SEQ ID NO: 8920 - DNA, 1219 bp, Homo sapiens
accttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatc

SEQ ID NO: 8921 - DNA, 1136 bp, Homo sapiens
gcctcagcctcccaagtagctgggattacaggtgcccaccaccacgcccagctaatttttgtatttttagtagagacggggtttcaccatgttgtccagatggtctcgatctcttgagcttgtgatctgctcgcctcagcctcccagagtgctgtgattacaggcgtgagccactgtgcccagccccgagtggactaaatgttgataaataaaaaataaaatgacaaaacttttaaaagttaatttaaaaactcgttggagtagagaaggccttttaagtgagacatcaaacttagatgccatttaaaaaggaaggcaagcaatagactgggataaaatattcgacatgtaatagacaaaattaatattcaaggtatataaggtgtacctacaaatcaatatgaaaaagataacctgatagaaaatgggaaagaatgtaagcaggaaatttatagaggtagaaatataggtagcctgttaagttttgaaggaatactattgaaccgaatataaatagcttcatctttttaggagaaaagtttggcagtatctatccatttcaaatgtacgttctcctgagccagaagttttatttctatatgtctgtaatatagaaatgctatcattcattaatagagagtattgcatgattattccatgcagaggagaaaatgtatgatgggaaactggaagtaataagatcatcattagaacagttaaattatggtgtgcccttacactataatattagatacttatgaaaaaacatgaaatagacatagatgtacttcttaagatattttacatgaaagggcgagatacaatataatacatacacaaagacacaattcatacacacacaaaaaaaatacaatacacaaaagcagtgtatgtgatttcacttacataacaaccaatcccagaaaacctaacacacaggtaagcacagagaaaaagactggaagggtacaccacagttgttagctatagaaataggagttggattagggatcaggaaagagttaaaaacaatgtttgtatgtgtattttcaagtataagcaagtacagcctttgtgatataacaaacataacaacacatgcaaggctttgttatgattggtcctgattaggacca

SEQ ID NO: 8922 - DNA, 1222 bp, Homo sapiens
taggtaatgggtttataggtgcaccaaaccaccatggcacatgtataccgatgtaacaaacctgcacattctgcacatgtatcccacaacttaaagtaaaaattttttaaaaatttctctaagttaatttaaatcatttgtgcagcagttatggcaatttcacaaataggaagagttcacatattatacttaaaagaaaccaggcagtagaatttataagcagtgtgataagcattacctgtctttacttgccagttaagtttttatgaaaataattttattctgtgtacttcatagagtgtaagtttctaatagagcacacatctaggtttgtacatctcttttcaaattgttttcaataaatactgtttatggtgggtacattttaactaatacagcattgatcttttctaacacatttgcagaggaagatactcattactgttttagtgtgactcagaacacaaaaagtgctatttatgattggataaccagaccctgaattataagtagcttatatttcaaaagttaatttgtaactgcaatctgtaaaccccacctccataaatcaattaaattgattttatatgcggcagtgacccctttggtcaggaccaaaaaagcctatctaatttataatgtgcctgtaatactaacagtatcttagtgataggaactaactaccatgagaagatatttttaggcagggacacatttctctgcttcagtgggaaatggattcctttctctatatgacagattgtaagattggagactgttttaaaattattgggtagaggttttaaaaacacaggaaaggataaagggaaccagacagaaaataagaaggctctcccctctttatgtttttgactgtccaaaattacaagatggaatatgggtggaaggaatagtagtgagcaagggaactggggttgaagtctttgtaaaatcaacatgccttcactctgagcaagagaagacaagaaaagacttctggagttcattttcttccacttagccatcactagtttctgtcatatggcaagccccttcgtggactagctctggatctaggcaaaaagtgagattattaatagaagtggaggcaacagataacaaggagaaagagaaattaagggaagaaaatcatatgccagcgaagtggagagaaacatagatcattatagccctaaggccatcaagttaggaaagctgttct

SEQ ID NO: 8923 - DNA, 1179 bp, Homo sapiens
taaagaaactcaaaagcaatctagttttacatgtgctcaggtaaagagcatttttggccaaaagctatttaatcaacatcaagactaagacctttatccttttcttaatttaaaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggtaaagatgatcagtaccttgtcacttaactctatccagagttttatatttcattggcattttcatggtcatgactttgttaactcggaggctctgttaatttgtaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacaggtatactctaaaaattatgttgatttttgcctagaccagagagacgctttaaataaaacaatcataaccaaactttttttcttatgtggcacttagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtaggtttttttaattgcttctttatatagtttcttaggtcttaagtatatacatttctgtaactattagaagtaggccaggtgtggtggctgacacctgtaatctcagcactttgggaggctgaggcaggcgaattgcttgagcccaggagtgcaagaccagcctgggcaagacagtgagaccttgtctctaaaaaaaatttattttaatgaa

SEQ ID NO: 8924 - DNA, 1169 bp, Homo sapiens
attgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtat

SEQ ID NO: 8925 - DNA, 1176 bp, Homo sapiens
catttttagcccaacagaaattttctgtttaaagtatttaaaagtttttgacttgctaaccagtagcatggcacagagcacataagaaattaacaatcacttgttgagtacctgctatgtacagaatactcgaacatgttgaagggatggaaaagaaatatataacatggtttctgctctccaggatctataatttatttgggaagtaatatctgaatcaagtgaaataatttgttagttaagtaagatagtatttaattaattgcaaaaaacaaggacttccttgagattatagattagagaggtggttggccttcttggaatttagctttgacaagatcacactgcagtaggagtatctggtattatattttttgatagctcagtttactgtagaaaattgaatgaatattcattatacaaagtatgatagcaagcttcaaaaatacattgcaaagtgtcttttcagaatgttgaaactaaccattggtttgctcactctcgtagagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtatgaaatccttcttggtgtacttttctttaaaatgtagcaagggttggttgaaattaattttcttataattgtaatttatttcctttttcaaattccaagaaagtttcctttcagaagtataactttggtaaagcttggtcctcactgccagacctgaagctatgacctgacctgaggtcatcgcctcttcaggtcttcccaatttgttgagcatgtctttttttcccttgcctctctccaatatgaaactgctttaagtttatcctttgggatcttgctcagcctctcatatttctggatgttaaggctcctttgttttctaaatctggagcacgcatttattaatacagttacacgccacagaaagacattttgagcaacgatggactacatgcacaacgtgttcccataagattataacagagctgaaaaattcctgagtgaagtagccattgtaacatcacacgttaccttttttatgttcagatacgcaaat

SEQ ID NO: 8926 - DNA, 1165 bp, Homo sapiens
tttttttctgactttatatcaggttttataataaaagtcaggggaaatgtaagagtcatttaacaaactgtcttaatagtgaactcctagcatacatttatgcaggtaaagaaggtatcattatggtaccaattttgttattacttctacctgaatgcctatggagcaatacattagtgcgaagcaagataattaaagtgagtattgaaaaccataaatttatttctgcctagctctaggtgagctgcagcaaagaccaactaaaaaaaggtactaagcactgacatcagcaaagcagtgtgaaaaaattgctcaataactattgcttttatgcctgtgctttgagatgcacttaaggacactctaatttttttcacaacaccattcttactcacatttatattttgtttttcagtgagaagacgtgagctatattttgaatcaggtggctctgagattacagctttggttttgtgttttcctctagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtaaaaagtacaagctctggaaacaatgttgtaggcaattttttttccagttccaaatggcaaactccctgctctttactctccttcatacttgaaagaaaatgaaataggcagtctttgtgttttgcatgatttagatgaaatttcagagttatcttaatgaatgcccattcataaaggtttgctgactaatccatacatctaaatatttttattttttcacggagaaaatgcatgatactctttcccaaaacttctaaaacaatcagtgattgagctagatcccaaaccctgagtgtcggccttgaatgctttgcttcctacaagcactgtctcttcgaactttaaatgacgccctgaagacacagtcgggtactactcacattattaatattattatttttttacaatgtattttgttatgatagaaaagtaacccctttagacaatagtggtttttttgttttttgttttttgttttgagatggagtctcactctgttgcccaggctggagtgcagtggtgcgatctcgg

SEQ ID NO: 8927 - DNA, 1169 bp, Homo sapiens
tgcactccagcctgggcaacataggaagaccccatctccgagaaaagttttaaaaatagatataatctttgtatggctgtagaacatcttaaaatgtgtatcttagagtctggcttattttaatattgtctaagaaggtagaaaataatcatagtttttttaaaatgaggaattgaactataaatttgagatactaatgaataatttattttaacagaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacatgtgagtagaaaaacatggcgtttcaaaaaaatcttctgaatgtaaggacgcttgttaagaagtcttgctatgtattaatttgtctatctaaaacctgttcaagagttacagtaagactgggcgtggtggcccacgtgtgtaatcccagcacttttgggagaccgagtgggaggccagcttgagcaaaggagtttgagaacagcctgggcaacatggcaaaaccccatcttaacaaaaaatttaaaaattagctgggtatggtggtgtgcatctatagtcccagctactctggaggctggggtgggagatctgcttgagcccaggaggtcaaggatgcagtgagctgtgatcacacactgtaccagaggcctggacaacaaagcaagac

SEQ ID NO: 8928 - DNA, 1085 bp, Homo sapiens
tggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggcacatagagttgtttttttccttcaaaatc

SEQ ID NO: 8929 - DNA, 1266 bp, Homo sapiens
ttttctttcagagcctctgctctgtcacccaggctagagtgcagtggtgcgatctcggctcaccgcaacctctgcctcccaggctcaaacgattctcctgtctcagtctcctgagtagctgggattacaggcatccaccaccacgcccggctaatttttgtagttttactagagacggggtttccctatgttggccaggctggtctcgaactcctgacctcaagtgatccgcccgcctcggcctcccaaagtgctgggattacaggcgtgagccaccgtgcccggctgggattttctttttaatgtgccactttaggttgaccatatctcttcattacctttctgtttcttaaactaacccacatcttaattcttttctctgatgtcttgaacgtgacaaaacacattctgcagactaaagtggcattctgccttttacaacaatgtctttgagcataactagattatgtgataatcgtgcaggaaattctttcccttgtagatcttgcgtgtgtgtgtgtgtgcgcgcgcgtgtgtgttttgaagagtcgtactttgagttagaggaccattgcttttactgcgttgaataaatagtatgtgtttttctcacacctacctgtggtcacctttttgcctagttttaggtatctggcctctcaaatatcttttctgggggagggtgagagatttggggtaaagggctcagagagaagtaattcaatcaaagttgcctaaaaaagccatttttgtttttatttttgttgtgtgtccaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgg

SEQ ID NO: 8930 - DNA, 1101 bp, Homo sapiens
cctctactttcatttctaagtaagacaggaaacgaaccaaggtcctagcagctgtgctgcaggttggaacataaggtgccacaactaattggactaacaaacagcatattttagtttcaagtctttcttaatgtcagcatatgtgtttatttcgagacttaccttgctgtctttccacctctgccctgtcataagctggggatgtgtatgatttgtatctgtgtacgctctgcaattctattagtgtctaattacagctcacagttatttacctgttaagaacttgctgtggactccttttgtttttgcactgggttgagttcttaatctgagattcacagatctgttgagcctgtgaattaatgggctttggggagtctgaaagtttgtgtgcatttttttgaagaaccaaagcatcagactgtaagctcctcgtgagcaggaactgtctcattcgtctgtataccctatagtgcctggcacatattaggcacctgataaatgttgaactggatgaagatagtaccttaaaggaagcattaaggatgatcagtgagctgaaggcgggtatggttggtttcacagattcagagagaataaaaggtagagagcaatagccttggagtttcaaaatatctagctaagttgtgcatgtagaatgttacaattagcctatccttgcagatactttgtcatttgacaaagcagaatatctggtatcaaggagtttatcaaacacctgcaaagatctgcagctgtgtcctttgaggtataagaggacacacttcatcacacatagggatcaaagttgaccacgatgttttcaaaatgtatcttatttttgtttgaggctatattctgattataaatatttgataaggtcaaatgtagctgactttgtctgcagcccgacaacagatggaatgatgatcaaagtaaatcatttctaatagaaaatggggtatgatttttttcctgtccttcctgtgacaccctgaacctctttattagaaaagctgtttctttagattttatttccacccggtgatataattttaaattgggttagtgccttttctgtccatttggtgacggatgtta

SEQ ID NO: 8931 - DNA, 3085 bp, Homo sapiens
taaggatttttttcttgttttttacagattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttatttctgaaaataacttgtttgttttctgtatggttaaatttaaatttggaattatttttttaaaaatcacaatggaggtaaatcatgaattactcttttactgtattttaatatctccttcacaccatattactgaactaaactggagtctgttcacctggcacagttaggccaaacattcatagcaaggttttgcagcaggaaaaaggagggcatttatctgcaggcagggcaccaaacaagaaaaatgaggcagctcacacttaagacccaacttccctcatggctttacaagcaagggtttttaaaggcaggggtgaatttcaggaaagcataaattacaggcagaattgtacatcagtacacaatggtttggcctagaaaggtgggctgtcttgaagccgagggtggcagggggtgacttataggtcataggtgaattcacagattttcttatttgcagttg

SEQ ID NO: 8932 - DNA, 1178 bp, Homo sapiens
ggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgctttgtagtttggtaattcttagattttactattggtttctttgcttagaatgagtttctaaatgtgaactacaaaaaccactctacttcaagcatgatcattagaagaaggttagggatgtccccaagcatcattttatcccttaaaactacagatagtttaggtttctgcctgaactaatctaagttagctttttcttcacatctcataaactaatggtgggaggacacaaagagctttatgaaaacatttttgatggcagataaggacggagtcataaagctgtatccatgcagatgtgttatgctgacattattgttattattgagatggagtttcactcttgttgcccaggctggtatgcaatggcgtgatctcggctcaccacaacctccgcctctggggttcaagtgattctcctgcctcagcctcccgagtagctgggattacagg

SEQ ID NO: 8933 - DNA, 1178 bp, Homo sapiens; identical to SEQ ID NO: 8932

SEQ ID NO: 8934 - DNA, 1104 bp, Homo sapiens
ttctcgtggggtgggggggggtgtaactctaacacctgatgacagcttgaagctgcgttctgtgttctttgcttgtgttttcaggtcatgtgcagcgggtacgtgctagtgatggccagagcatgctaatgccactgctcattctccttagctcttctggggcagggtcttagccacttacatgtccctggttcaggcagtgcagagggggctctgggggtcgggtcttcgtcatcctggctcgcctgctcttggctgcctcccaaactgccaggcgagctggtacttggtggaatgcctttcagctcacccccctgctctgaggccgggcatttcgcccttctgcagagctgtaaacattcactcatccatgcagacttcagcatggtctttgttactgctctcagggaaacctttgtgtaactgatagagatggcacagggctgagcgccctgacagctccactggagagtctcagaagccaccttctcccgggcctcttcacacccaagcctctcacgccatgctataggctttcttgggtgactgttatgcattcctttcacttgtgcacccacctgtggtgctggcctgtttgagttgccctcgagggcactgctgagatgtgaagacctgggcatgtgccaacagggagggcagtttctagcttattcttcctccaagacctggggccagaggaaagaaatgtaagtgggtgtccaagaaatgaagctgttggctggtggctgggaatgaagccagtcagaatgaggtgggagagccgtgcagaggggccaggcgggagctgccgtggccacacatggatggagaatggcagctggccactctgctgtgaaagggatacagtggagaggcgagcacacttctctgcagagcctgggctgatggtgcacacggaactcggatactggagctagtgctcatactctgtgtgaccttggcaggctacttcacctcctgtgcctcaatttcctggtttctaaaatggggacaatcatagcacctcccctttctatggtggttgtaaggattaaatgagttcatacatgtagaacatggagaaagcacccatgttagctaaca

SEQ ID NO: 8935 - DNA, 1210 bp, Homo sapiens
aaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaatctgcctgtgagtgagatgcgtggtcagaggccagtgccgtcttgtcttcacgagg

SEQ ID NO: 8936 - DNA, 1215 bp, Homo sapiens
ggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctggtacgtagtgtgtttgaggcatgtcctgagcttgtctccttttctctttgtgtcttatagctcctggatggtggtataggtgagccctgctccctgcctcccatgtcaacagtggaacaaaatcctgcaaactttccttgcatgttaaatttgttaagatagaggaaatataatctccaagtgtctagattttgcttttcatgtagttgggattttgtattagtctgttttgtgttgcttataacagaatggctgaatttgggtaatttataaagatatggaatttgtttcttatagttactgagaagtctaaggttgagggccacatctggtgagagccttctgccagtggggactccggtgccacagggcatcacatggcaggggtgctgagcatgctcacgtggttgcttaggtggctcttcctctttttagaaagcctcgatgccacacctgtgataacccattaatccatgagtggattccattcatgagggtagaaccctcatgatccagtcacttcttaaagccctcacctttta

SEQ ID NO: 8937 - DNA, 1140 bp, Homo sapiens
cttgattttaacctaatatattcttttttttgtttttgtttttgtttttttgagacggagtttcacacttgttgcccaggcaggagtgcagtgatgcagtctcggctctcagtctctcagggtaggtagcaggcttttttttttttttttttttgagatggagtctcactctgtcacccaggctggagttcggtggcatgatcacggctcactgcaacctccgcctcctgggttcaagcgattctcctgcctcagcctcctgagtagctgggattacaggtgcgtgccaccgtgtctggctaatttttgtaacttaatatattcttaaccattacattctattttaggtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaa

SEQ ID NO: 8938 - DNA, 1140 bp, Homo sapiens; identical to SEQ ID NO: 8937

SEQ ID NO: 8939 - DNA, 1349 bp, Homo sapiens
cattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaattatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgtaataattatttgtaaatattatttagatttgtatttagacatgatttatatctaatatagatacaaagtctgtgtctaaatattatttaaagaagtgatttttcattctcttggattctttccagtgtggtgccttttatatgcctcacatagtctccttgttctcctactaatattcccaagctccatatgccaattaaagaagaaacaaaaataaaagtttgtcttgcttgtgaaacattaagaagaggctgtcaggtttaataaactttttaatgaatatttcagacataacaaaaaactgcagagcttcgtacacttgatttaaataattcttgagggattttataaggtcatcttatagacaaaattaagagacaccagtgtggttatcaatgctttcagaatacttgtgtttatgtaaatataccccagagtccaaaactctgatatattcatatatattcacaatgagaggatgtctgtgccaaatctgtcaatcagtacaatagaaaagttaattatataactacaacacgaaacacaaatttttagaagcaaattatgtcctg

SEQ ID NO: 8940 - DNA, 1131 bp, Homo sapiens
ttcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacatcgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacaggtttgtattgagatttttttaacattttaaatcaaatccttcatgtaatcaaaattatttagaatttaggtgaaatttaggtgaattgtaccatcatttttatggttcatgccttataatgtaccaattggcattatcacccttagctgaaaaattaagagtactggtaaacctacttaacctctttacatctcatttccccatcagtaaaataggggcaatacaagtacatacttcagagtcgtggagattgaacgaaatcaacatgtaacactctcaggatagtgcctggcatttaggaagtgctgaataaacattatattagatttttaaaatcccattattaaatcatatggtaagttaatggcagagattattggaattcaaagccaaatcccaaattagcaacttctgtcctcctctagctgagcatgtctcttctcttaagt

SEQ ID NO: 8941 - DNA, 2532 bp, Homo sapiens
tctttggattttagtaggacattcagtaaattatttcttgcatatactggtatacattctgcctaccattagaacccagagtgtgtttaaattagtgtcctaaattaattacattttttttctgctgtgtgtttctattaggtttcagaaaagggatccctaacatcagaagagtttgctaagcttgtgggaatgtctgtcctcctagccaaagaaaggtaagtaaggttcttacctttcattacaatgtatgtttgtgtgtctgcatgaacagataattgtgtgggggtttttttgttgtttttttttaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgtttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataa

SEQ ID NO: 8942 - DNA, 1359 bp, Homo sapiens
ttaaacaaatagaatgtcattagaacatttcacctcttaaatactgtatttactttccctaactattgccattttgaaaaagaaaacttttatttgaatttactttaatctgtgtgttattaataacagtaggttttggctttcaggaattagccagttctacagatactcaggtatctactgtatacaagttgtaatgacaaattgagaaaaggataagtttctcacttcggtgagcttatagtacctctctaaaagacaattaaatgcttttacctgcttataacatacaagctatatagtatggtacatatcatgaaagtacagagtaaaaatgttaacatgtttttgaactctggaatattgttttaattttcagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtg

SEQ ID NO: 8943 - DNA, 1730 bp, Homo sapiens
ttggttatcatggtgataagttttatgtttcttttttccttactgtagaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaaaatgctttcttttgtctctctttttttgaaaacattctgtggataagctgagaatagactgtgctatgcagtctgtctaagcatctattttgctttattacatgtaataagtaagtgactgttcttttaccttcagttaaaaagcagttatatggaactagtcgggcaaggtctattgctttttatttccttaagttgccacctcctttcagctctaagttaataaagttaattaattagaactatgagccaggccctgtttatagacattggagaacagagtattctctgtagccagtgtaggaataaatgtgaatttgtatgtattgctgaaatgtgcattttgccatccagttgcaattcctgtttttctgaaaacaaaccttaaaaatcaagaaaggtgaaggacatttacatatt

SEQ ID NO: 8944 - DNA, 1147 bp, Homo sapiens
cactgccccattgaaagacatgataaggaaaaaaacattaatgtaaaaagagacccatttctatttctttgaagttttttaatatctataaagagaaaagataatttatatgaaaaggctttatagatgagtatattttattattattcttgatttctaacatctaatttctactccattcaccaggacctcttcatcaacaatcttatacacttttatttttaatgtgtttgtatttacatctttgttcctaaggctaatgttttattatattgcattttaacactcaattactcatttttcttaaatgtctagttaggacagttaaaccatcagttgaaaactaaaatgttgagacggaatagccccacagatcacttcccttatgagggaagggtcactacatcagccatctgagcccctcttggccaggcattgaggagtgagactctcaggctggatctatggctaagtacaaatggaagaaatatgtaaaggattgggggattcttgagttggttaactggaccagggtgctcaattatcccatgaaaataaggtcctgaggtagatataaggaggtgtacattgtatggaacataggataggaaagtcagataagagcaggcaaatagacctagccattgtctgggaccgatggctgccctttcccaaagtgttatactcagattaactggttctatctgtgaataacacattcacacaaattcagcattatttgattcagtgatccttgttttattgtatgtgcattccagagaatacatgagttacatataaaagatgacatatgtaggtccagacacacaaaaacacacatggacacacagacatatgaacatatgaattatatggaaatagaaataagtggttttatataaaatgctttctataaatttggctatatgaaataatacatgcaaatctatacagttctagaataatatacttgtaaagtgaaattttaattcatagaatggaataggctttttatattctgttaaatatggcagctatgttttcaagagaaatatttccccaccaagttaataatcaggttggaattttaataagtaattataaatttttagcagaggaaagacattggtcatcaaagcatatgatg

SEQ ID NO: 8945 - DNA, 1158 bp, Homo sapiens
ggcagatcatgaggtcaggagatggagaccgttctggctaatatggtgaaagcccatctctactaaaaatacaaaaaattagccgggcgtggtggcaggcgcctgtagtcccagctacccgggaggctgaggcaggaggatggcgtaaacctggaaggcagggcttgcagtgagtagagatctcaccactgcactccagcctgggcgacagagcgagattctgtctcaaaaaaaacaaaaaacaaaaaacaaaaactactctctcccatacctggttgactttagaatagaagatgatgccttgaaaatagctcatctctacaaaggaaatgtgatttataactcaagactcaaacatgactagaaccacattccatttaaggtaattgtgctgttggactataaaagcagtgctctgaagtgaatccgtggaactcggtccctttagtgcacagtaacataggcactaatgaggcagttttcattaaaagatagttgatttaatgagagagttaaagtcctgtcctattttgaaattgctagcttagtcctggcatctgatcttttttctccctaccatcaccatcaccagtttttgtatatgctttgacattgctatggtaaccctgagggctgatggaattccctgcatctcttttcacagagggtgatgagacaggagtgatggataatctgctggaggccttgcagtccggggctgccttccgcgacagaagaaaaaggacaccgatgccaaaaggtgaaccctatacttgtttcatgttactttctagggagctatcacagagaaagaatcctgtttttctcattcttttgaagttgtgtgtcaagaatgcagtgccgtgggcaacaactgttcagaagtttcataagtttgcttaatcccttgcacagacaaatgtcagagagatatgcattccagttggccgatgtcagtagcacattaacaaatcaatgcactgaacctagaaaatcctaattagtgtgacaagtctcatctaaagaaccatatgtaccttatcccagtggagtttacagtagcataattaaatgggaagtaaaagtcataacattactgcttcaagtatttcaggatattgaagcattactttgctgccagaaatacataaccttgga

SEQ ID NO: 8946 - DNA, 1214 bp, Homo sapiens
aaaacaaaccctctttagacttttctgaatgtgttttaaacatgacccagtatattgcagtattgaacaaaaattattcaaaataatgacatgaatgccttgtaatttgtggcctatgtatcttgttacctttttagaatttagtttaaaaaatgcttactttattgcttaattaaacattatcatttaattaaagctttcttttcattgagcatctaaattgttaatttgggttttgagggatgactctggattccttacaaaaacaagcagggcttttctctcttcctgctatcagttttaggagacatatttcttctttggtactgtcataccaataaatcatcccagattacttgcagtcgtacagtactaaactataccatgcattttaaaggaaatctgctgttttcttttcaatcagatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaagtgagtttgtttttttaaaaacacatatttgcctgaacacttgctcttaaatgtcagccctgattgcattatttaaatatttttttattttgatgtgctcattatcaagaacttgaactgaaccatgaactcaaacccagagtgaactgagctaatttactcaacctctgaactaaatccaaatattaattttcttcaatctgcaaatccaattcaaggattttatttaataacaaaattatatcataaacctatgctttctcaaaccaatgaaatggaacgtcaaaatattattaatactgactcgtacttactcagttcagatacctgtatatatattgaatattgcttaggattgccattaacatttttacctttaactatttaaatatttctctgcattgctttcataagcagactgaaaggagagaaaaatgggacccctttatataaaggggaaattattatattggaaatatatgcaactcggatattattgattttgaagtgtttctatctaaatataattctagaggacatgaaaatggag

SEQ ID NO: 8947 - DNA, 1190 bp, Homo sapiens
attttgagaaagggtccacttctttgactgtcaatggggtctttggcaaaaaaggttaagaattaatttagactctctaatttgtgcagtggtgagagtgaagtaacatcaaagacctgggcctgagcctcagcttaactgctgcctatttaaatttatattgcctttttttcttttttttaattcaaagaaccaatacatgtaatgaaatatttcatccaacttagaataatgttttaaggcagtttcaacatcagactgtccatttttgaatctcactttagcagactactctgatgcatttattaataaaagtatacttaggtcaaatctggacaaaatatgaaactcattaattagataataataaaacaacatattattgatgtattttttactagtcaaatgtttgcttatgttactttatttgctcccagaaacatttatgtgaaagaatcaaggcagatattgtatacatttatatataagaaagttacattcttcggtgaatttcagctaaaagaagcagcccctctgaatggaatacagatccgagtctaaagccattgctctttgtgctatgccatgctgcttctctgattaaaagaaatcctattatgttttatttaaagtgctctgcattgatttaaaataattttcctctcatcttctgccaccttaccactgccccacagcagttcaccctcattccacaatgtatattaaaggctttaaaaacttgccattttttattaaaaccatctttcatcatttcgtacctctattcacttctgtaagtatttgagctgtaaatactaacaccatgctgtgtaatatacacgcgaagtgagggatgttgtggagtccaccctacaagtgtgtgaccctggcttttacagcgtagtttctttcctctataaaatgggggacataatacccatatcatgaggttattgtgaggattatataatgcatattgtaaagcatcttttgcagtgcccagctcattgtagttgctcaggaaatgttagctgaacttaaatgttgagaatacagaactcatttcaacttgtaaagttttgtgtatcatctctgaatcttccacaatgtaacaagttaaatggcctatgttcactgtagccttgctttcaagtgaaactttctaaatcatgaaactactgtgttaactg

SEQ ID NO: 8948 - DNA, 1336 bp, Homo sapiens
cctcattgctttatccttgattttaggtctgtataaacttagctggacaataaatttatcaggtgtacagctcatttagtgattctgttctgaactacagcaatactttcatattcttcctacttatttgtgaatatttatcctttattatgtcatttattaacctattttctttctctgcagtcaacttagaaatcttttataaaatatttgaaatattttacagaaagaagcaggatagaatcactaaatcttttggagattctggtatttcttttctcctacttttataatcaagtggttgttgacgttttatgaatttgcgtaggttactataacagacatctctggatcatgcacattatgatcagcctttcttctttatctgcataaataattaacttagttgagagaaatatctcctcgaaatatagaggccaccagcttaacatatctcaacctatttctattttaaaaaatatttgtgtgcatatagatgtaaaaaaaccctgaagaaatatagtctgtgttgctgtcagtacatgcaatgtagagttcatatagaattctcttagcccctgagagtattgaaagtgttaatgttggggtctttgagtactttttaaaaattttggtaagaggaaactgtaacaagttttaagtcaaaaatgtacaaaattatcaaaaaacaaaacattcactgtaccaataagaaggtaactgtaactgataagtcatactagaaaaattaaagggctgcaaagctgcagggaaatggttagagaggccttagcacaattacactatggattgtggaatttttaattttttaacttgtgcactatatatgtgcactacaattttttttattgtgaaatggtattgtatctttcattaagatttatgtttgtattgccacaagattttggaaaactcttgttttcctaaatgtagcagtgatcatttagtgaagatttttttaaactagtttgcagaaaaacagtcaaaaaagcctgcatataagccaaaagcctttgtagaaaattagttgcttgtgttgtcttttaaaagtataagcataaatcattaaatagaaagcatgatatatgaagtgactcgatgactaagttaataccttgttgtatggaaaattaaaataaaaatcaagttaatactttaaatctaagtgttaatgtttttctcatgaaatttagaaattatttgccttaaatttgtcagtagaccaaatatttatttctccttttcgtgtggatatgtatttttacttccagaacatactcagggagtatatttttgaaatattttgaaagtatta

SEQ ID NO: 8949 - DNA, 1269 bp, Homo sapiens
gaaaagcactgcattactgtgataaaagtggttctgttttatggggaatagttgtttgttaatgacagtgcagtattgacaaatttatcttcatgatgcctctttttccatggttttattgtaatgaatcttactttcttgttctaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatatt

SEQ ID NO: 8950 - DNA, 1273 bp, Homo sapiens
tgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctttaatcacacaggtgttaaactcaatataaatttacctaaaaacaattgctatacctaaaaggagttctgggtactaagggtagaagcctcactggctacagttttttaatagtacaaaagtcaagaaataacacaatagtgactataacctgtattcaaatccctactctgtcactacttgatc

SEQ ID NO: 8951 - DNA, 1138 bp, Homo sapiens
cactaccgtgcccagctaatttttagtagacatagggtttcgctgtgttggccaggctggtcttgaactggcctcaagtgatccacccacctcagcctcccaaaatgctgagattacaggcatgagccaatgtgcctggcctcttttatgtaagtttttaaacctataagttttattgatcatgactatgaaaagtgagttctatatagattctaatcaacaaattttgaaaagattatattggaagcacattttaaacttgaacattaataagaaatagatgctttagaatgtaagagctggacccttacaaagtttccatcataaatcagttgagaagtcttgtctaatttactaaagggtcatttttcagaaatcgttatgggaatatttaggaatactgagaagatatgtaaatgctgaagaatttaatatgataagatgtaaatttgctataaaataggcgtttctaataatgcctcttggtttcagggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggtaagttgaaagtaatttgtagtgactttataaattattatatcctgcctagttttgtttaatttctatatgtgtttttaaatatgtagacaccacgggccctcttttcctgcattttgttgggtatagcattcttaggaattatagaagaagtcatttgcttcttcattgaagggtaagtttttctatgtggcagacactttcatatgttaaatgtttcaaagggaaggaaaccattagttacaaatcatacgtggtgtctctctgctccagtgcaggaaaaagaaatgtggttgtcatcaagaaaatacagctaaattgtttttgtatacatattactgatttcacaagagctattaatatgttgtagttgtgctttggaaataatttatttgtttatcatttcatgtcttctaggacatgaaaaaccgagaagacctgaggcatctgtgtatttgtagtgtagacccaccaggatgtactgatatagacgatgctc

SEQ ID NO: 8952 - DNA, 1217 bp, Homo sapiens
cgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccaggtaggaagagccgctcccctcccaccgcagcactcccgggctcgggcgtgtcccgttgctgcgactcgcgggcgacaggggccgctccaggctggggcgtgcgtcggggcgcaccggagccggtgctgggtgggcagccccgccctgcacgcctggccggggccccgcgtttcgctgagagtaaatgggggggggggccgggggtgggaaggatggaggggaatctgccccggcgggtcggcctgggagaggtaagagggagggaactgggtgctcacgcgcaccttagttgtttttcttacacttgagggacgaaaccttgtaccttacgctcagttttacttaaattacgccttcgcctgtaccgctctccaatgccaaggcattggagccctcccccccatccccatcgtctcgggttaagtagaaacgcaaattggggtgctggggagaggttccccaaggtttcatacccggtggctcaacctgctttagaagcgattgcgggccgcgtttggaaaatgagagttaggaaagctaaggttg

SEQ ID NO: 8953 - DNA, 2556 bp, Homo sapiens
ggtacacaaaatgcttttttctttatgaggtaaaaaatacttggaggttataagaaataactcttaactagcttactttgagtggctttgatatgtatttactcataatggaattcatgagctttccttctttcgcttggccaagattttttttttctttgaaattccttctccggtgttatctaggatgtttgcattacaagcaggccgctttacctcctttgttcgttgtcacaggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagatgtatgtggtgcttttcttctttacctgcaataaagagtctgatcagggcggttagtgagaaatcaattccacacatttgtagaggagccacattgaacccgtacctacataagacggggatttattttttgagacggagtctcgctctgtcacccaggctggagtgcagtggcgcaatatcggctcactgcaacctctgcctcccaggttcaagtgattatcctgtctcagcatcccgagtggttgagattacgggcgcacgtcaccacgcctggctaatttttgtatttttagtagaggtgggctttcaccatattggccaggctggtcttgtgaactgacctcgtgatccacccacctcagcctcccaaagtgctaggattacaggcgtgagccactgcgcccagctgggggatttattttttaaattagcataaagggagtcataattcacgaatacttatctggccacgtaatgcacgagacc

SEQ ID NO: 8954 - DNA, 1128 bp, Homo sapiens
attaacagctgcatgttttatgccatggcatcatttaacaatcattgacaggaattagattaaaagtattaagacaaccagtagtcactaagcatgtaatctttggagtcaaacagactttggcttcagttctgattccagaaatgtgtgactttatgcacattacctaagctctctgaagttggcttttgtcatctgcaaagtggaaacaataacctatagtgttatgttgattcagtgaggtatgtaatacatgtaaactgcatagcacatcacccagggtatgtatctgtcatgaacaatgatgaaatccaaaaccaccttatcactatacatgctaatgtaagtcttgagcatggaacagcaaagtgaactaaaagatactccaagcctgttaaaggaaaccaatactgccacatcttccttccacttccgttatacattggaggggagatttttttttttcactttttgttttttccattttaaactatgatggtgttttttaactgtttatatcccttataacctctccattttttcatttgattattgttcctctagcagtattaaaatgaagatactttatgtaaatatgaccagcgttgaaactaaaagttgagtgtaactgcagtaaaattgaataaatatctgcattccaggtaatgttactactaatgtattattttgtcctgtcttattaaagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcaggtttgtgatttaactcatccagttttagctcagcttttctgtaatcattgcataaaaagatgtataaaatctttctacgggaaaactttaatggtttttatttgtagattgatatgctttacgtttactagtagtatatgcaagagacattaatttgtcttctttgggaatttgataaattattttcaatataatgtgctgaagttgtgtactgcgccatttgatcgcttgaacagtactcctctctgagtatatttaggaaagtttta

SEQ ID NO: 8955 - DNA, 1215 bp, Homo sapiens
ctaattcatagttttatatggttctatcttactctgtttttattaggattaggttttgaacttcaaaaaatgtcctttggcctccgtcacagtggtcctgtaattacctaacctataagtttagtgttagtaataactttttaaaaatatggcactgtctgtgcattactggaatgccctaaccttagtgatggtgtattttttaaatgacagagttaactgagttttatttctttttaatagatgggatttagaattggtttcattttcttgtagacaaaattagtaatagattttaaatgtttgttacttcccttctaattcaactatgcacattttaaattatatagttttgtggtaagggaactgtgacaaacttttgtgggacatgtacttgattgaatttttcaacagataaacttttacaaaaacttgcaaataattttttttttctttcaaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatat

SEQ ID NO: 8956 - DNA, 1067 bp, Homo sapiens
taaagtttgtgtgctaatcgaaatgattcactaaattgagagtaattgatgatgcatgagagagaacaaggtgattgcagcataaaaatgttgagggaataagattcacagcacaaggggagggactagctttggatcagatccaggacacttcctccattctaccatgagagaaggcaggggaaagtaggtttattaatcacattgcaactttgaggttgtatctgattgcttattgtctcacagaagaaagaggtgaggtcatgatcacctgagagttaggaagagaggtgatgcaggtttgaggtaagaaagaagtgaaattcaagcattttggagagtaggcaagcgtactatggcagggtggtaggattgccaggaggtatgcaaacaaattaaatgtttgctgaactatcgtaatgatgttgactgcttaaccaaaagtaaaatttccaatatccatcttatttcttttcagacccagtgagaatatgctgatccgtgtcaataatgatgggacttattgtgcaaattggactccaggggctattggactctacactcttcatgttaccattgatggcattgaaatcggtattttctttaaagccatgagctactacttacttcaaataactagagtcaaaattatttttatcttctagttttgcccattaacttgcactagacatatggataggtttcataacttatttgaggccttgttttctctttcataatgagtatttaattagtgcattaacattttgtaataatttctggtgtccgcccaggcactgtagccctcatgactctctccctccatttcctgatgttactagtcaggtgtgctctcttccacgctgctgttaccctgtctctcccctgtgggtgtgtctgtgcctctcctgactgtgagcagaaagcattcatgtttggatcttccagtgtagctcagtgcctggcacataatgacagcaaatatggatgaatgaatgcatttttaaatcgatcattgtgttaatctgggttctccagagagacagaaccaataggatatctataca

SEQ ID NO: 8957 - DNA, 1208 bp, Homo sapiens
taagaatatgatgcagaatgcccttacacttatttgtgcccagcttcccaaaaagaaaattgttttgttaagaggaaggcagttaatttggctagaatccaaaaactcattcagcatggctgttttcccttatttcaaatgaaaaacttttctaatactaaaatatgtaatcctgctttgctttaaattcccatgtctgtcactcaacaggaggcatagtgattcttaaatatttacggaacatttggtgagttgtaaagagaagtattattgcattgtaggtttttgcattgatgtgtcgatttttttgttttgtcccaagatttccttccagcaccttaatgaatgttcatatgatagaatgttttaagtatcagcaaagcattcatggatgcctgcttttcattctcagaaggctaaacctgttttgggtatgatgctacttcagaacatattgtctggcacaagatttcttctaataagtggtttatttaaactcaatttcggtggactgttgaattgaaaaacaccaaaggagtcttcttgtctggagactggattgttccagttttaaatacctgtgcccataagtatcccatttcatgaatgtgtgttggcatggggaaaaaatttccctgctctttgagtggagcgaaagcaattggttaagctgtagcagcttttttgtttatttttttaaagtaataataaaacttgaactgaaaaaagataaaacttgaactagaatactactcttgtatgcttagaatgtttatagtgttaaatgtttatgtggggttgtcaacatttttattatttatagttgaattatgttttgttaaatccatattgtttattatttttatattttgaaaatttttaaaataaaagtcttactaaaaacagttgttaacgttttaaaattgtcctacatcttacatcagttaatttatactagaaaaaaattgcattcattaggcattacataattgagaattctgaaaatgtttatacgaagaaatgactccacatttcctcttcccctctttaccctccattttcagttgtattaagtcaatcttggcaccagtatgtcactggctttatgtctcctcctttcacagatacataaatcctcatgatccttcccccaaattcctgactcctttcctgcttggaagtttttctctttattctgcttggcagcc

SEQ ID NO: 8958 - DNA, 1214 bp, Homo sapiens
aaagtccaattgacactgatttttattcacccttgttttatttttatccagccatactacctttatcacttttttttttttttttggtgcaaagcttaacattctgcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttgtttggtttggtttgatttttcactttttgcttttaaaattaaaaacaaagcaaaacaaaattgaagataccattgagaatcagaattcaagatgacttgattctcactaagatcactgcgcttttttaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctaggttttaatctgattccttgtgatttattataatgtagcagcatacttataaaagtggtctgtgctgagtcagatagagagcccagcccattagaa

SEQ ID NO: 8959 - DNA, 1149 bp, Homo sapiens
ttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcctatacttgt

SEQ ID NO: 8960 - DNA, 1203 bp, Homo sapiens
tgacacagtctctgctcagtgcaaccactgcctcccgggttctagcgattctcctgcctcagcctccctaatagctgggcttatgggcgccagccaccacgtccagctaatctttgtatttttagtagagatggggtttcaccatgttcgtcaggctggtctcgaactcctgacctcgggtgatccacctgcctcagcctcccaaagtgctgggattacaggcctgagccaccacgtccagccagattgtcacatttcaacatgagatttggagaggataaacatcctaactatatcagtatgttaaatatactatcactttacaagtatttatattactggagaagatcaggtagctcttgggaaatggttaattatacttttgtccaatattaaaaatattcatatttttaaatattttacttttgctaacttagagaaaatatatatttccagtgcttttgacatttgtttctaactattccttcctcatagaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggtaagtaaatctgtttgtttccctgtatttatctagccattcttagtctatttttaaaacttaatagattcttaaattaaaagtatctaaaggaatcccaaaaatgcctgatagaaattaatagcagtatacttccatttggaatacacctccactttgtagcctgtgccaagccagttactatggtttggagtgaccctgtgaattaagtatatcactggtaaaacccagctgcctgcaggccttcatagcttaaggcaaacctgctttggaatgtattaaaaggatattttaccctggatatctaattcagttgtaagggcttggtgtttgtagatattatagtttgataaatgagaagattatgttcggatgtgcaataacttgttttatttgtttgctttcagatgatatttcttattctttggttttgacaggaccaccacctccacttcctcctttgcagcc

SEQ ID NO: 8961 - DNA, 1146 bp, Homo sapiens
agctccctgcctcctccggaaaggcgagggcgcaggccaacggcgagccccccccgggcgggccccagaccctcctcctcctcctcctcctcctcttcctcctcctccgcacccaccgcccccgcctcggcctcgctgcctcgcctccacaacgcccagtctgcaccgccgagagctgcgcgccgcagcgctagcggaggagaggggccggcggagcgcgcagcgcccaggcccccgcgcccgcccggcccggcccggcccgcgcccccgcgccgcctccgctacgacgcggccccggccgcaccacttggcgatctggctttaggttctccgtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggtgaggcacgtttggctcttcccctcctggcgccgcggccggcgcgttgtgggcaacatggagtaggtgcagccggaccaggagttgggtccgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggcaaagtccagggagaggctgtccctaggcggggcgctggtggggctgggggacacag

SEQ ID NO: 8962 - DNA, 1202 bp, Homo sapiens
aagcgggcagctgaagatgatgaggatgacgatgtcgataccaagaagcagaagaccgacgaggatgactagacagcaaaaaaggaaaagttaaactaaaaaaaaaggccgccgtgacctattcaccctccacttcccgtctcagaatctaaacgtggtcaccttcaagtagagaggcccgcctgcccaccgtgggcagtgccacccacagatgatacgcgctctccaccacccaacccaaaccatgagaatttgcaacaggggaggaaaaaagaaccaaaacttccaaggccatgctttttttcttaaaagtactttaaaaaggaaatttgtttgtattttttatttacattttatatttttatacatattgttagggtcagccatttttaatgatctcggatgaccaaaccagccttgggagcgttctgtcctacttctgactttacttgtggtgtgaccatgttcattataatctcaaaggagaaaaaaaccttgtaaaaaaagcaaaaatgacaacagaaaaacaatcttattctgagcattccagtaacttttttgtgtatgtacttagctgtactataaggagttggtttgtatgagatggttaaaaaggccaaagataaaaggtttattttttttccttttttgtctatgaagttgctgtttattttttttggcctgtttgatgtatgtgtgaaacaatgttgtccaacaataaacaggaattttattttgctgagttgttctaaaaaaaaaaaaaagatgtatttcattccaactacaaagacattacaagtgtttgagatggtaaacaaactgattatcataatttgatcaatatgcaatgtacacatgtactgaaacatcacactataccctattaatatgtacaatgattatgtgtcaaataaataattataaaaagtaaaattgggggaaaaaaggcttatgaatggttatattatctattttaaactgttttcattgttcaattaaataacagaataacatattgagtttttacaactttaaaaatactctaatattgtttttcttttggagagagctgaaatacttattcttctctttggataagagctctcatatttaataaagtatgtttttaaatatatggctttcacaacaattaccctaatctgattatatctttgaggatagatttacaaatacatattgat

SEQ ID NO: 8963 - DNA, 1214 bp, Homo sapiens
gcatatttgtggtgtgctcatttaaaaaaattaatcaacctttaaatcaaaatgtataatagattttaataaaatctagagaatgtcaatgtttcacttggggaggtgtgtcatttgtatctcttccttttgggttttagagtaataatgttaagaaagagagagactttctgactgatcccttaaatttttgtcatattctgttatttccttgttttctctctcccttacaggaggtaaaatgcacacttgctgccccccagtaactttggaacaggaccttcacagaaaaatgcatagctggatgctgcagactctagcgtttgctgtaacatctctcgtcctttcgtgtgcagaaaccatcgattattatggggaaatctgtgacaatgcatgtccttgtgaggaaaaggacggcattttaactgtgagctgtgaaaaccgggggatcatcagtctctctgaaattagccctccccgtttcccaatctaccacctcttgttgtccggaaaccttttgaaccgtctctatcccaatgagtttgtcaattacactggggcttcaattttgcatctaggtagcaatgttatccaggacattgagaccggggctttccatgggctacggggtttgaggagattgcatctaaacaataataaactggaacttctgcgagatgataccttccttggcttggagaacctggagtacctacaggtcgattacaactacatcagcgtcattgaacccaatgcttttgggaaactgcatttgttgcaggtgcttatcctcaatgacaatcttttgtccagtttacccaacaatcttttccgttttgtgcccttaacgcacttggacctccgggggaaccggctgaaacttctgccctacgtggggctcttgcagcacatggataaagttgtggagctacagctggaggaaaacccttggaattgttcttgtgagctgatctctctaaaggattggttggacagcatctcctattcagccctggtgggggatgtagtttgtgagacccccttccgcttacacggaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttaca

SEQ ID NO: 8964 - DNA, 1434 bp, Homo sapiens
cccattagggattatgctgaatttgtatggtttatagttgttagagtttgaggtgttaattctaattatctatttcaaatttagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgta

SEQ ID NO: 8965 - DNA, 1434 bp, Homo sapiens; identical to SEQ ID NO: 8964

SEQ ID NO: 8966 - DNA, 1434 bp, Homo sapiens; identical to SEQ ID NO: 8964

SEQ ID NO: 8967 - DNA, 1434 bp, Homo sapiens; identical to SEQ ID NO: 8964

SEQ ID NO: 8968 - DNA, 1434 bp, Homo sapiens; identical to SEQ ID NO: 8964

SEQ ID NO: 8969 - DNA, 1434 bp, Homo sapiens; identical to SEQ ID NO: 8964

SEQ ID NO: 8970 - DNA, 1434 bp, Homo sapiens; identical to SEQ ID NO: 8964

SEQ ID NO: 8971 - DNA, 1399 bp, Homo sapiens
tgagtcagtaaaatgattccgcttatcaatttaatacagagataaaacatatctatgaatcagagtgatcggaactaaaatggatctacaggttgtttggcattcagcccagccctgctgagggttttagtggggctaatttctctgtacagtagattcatccctgttcttaaattgtgcctcagtgagggatatgatttgcttcacatgaagaagtagacacagaagtgcattgtttcagggaggagactttaaaattttgaaacattctttttatgcttaccttttttttttctaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcag

SEQ ID NO: 8972 - DNA, 1164 bp, Homo sapiens
gtgcacttggctgatgtttcctgcttgggtccctctcaaaccacaggtttccttctccactccctttaaaaaagaaaatttgtttcagtagattttggggtacgggtggtttttggttacatggataaatttacagtgcaatttattatttaaaggaaactgttttaaaatttatttttcattgtgtatcatttcaccaagagagtgattgttttcagaaaagatgaagtgtttgattgtacactgaggttttcataaacctggtggatagttgatgaaaactgagcatacttaatagagggctataagttctagaagatagaaaaaatggtaaatactgataaatactatgttaccttctttgggccataaaaatcagtgaataatggcattaaagggctctccccaggccctgtgcagtgtggcctggacatcctactgttcttttatgctgtctggaaaaggccgccacagactgtcacaggtgtgatgcagaaggcttccagccaggtttgtgaggaatgagtaattttgcttgaacaatggctggaatatcagagtctgtcaatcaggtgagtagtatttgctggcgatttggatagagaaatcattgcttgtttaatgggctgtttcttcatcctggactattgttaatgagagatgatgcattttcggaaatgacattaagttagcagtaatgagctagatttttattgaatagtatacactatataggaaaagatgcgctaaggcaagctcctagttattcagatcctaccaggtcttatttttttttctctgtctcacacgctcacacatatgcacacacaaagctgtgtaaagttttaatcttttgccatgatttcccagtgcctttgctattgctatcctcattttgtttatttttctgatattgctagcctcgcttttttaaagtaaaattttcattttattcaaagtttgtacagaattgctaacatttccctaaaataattactatacttcagcttgtcctgctctggtgtccccccactgtcccctgcttccctgaagatccattttagagaaattttgcagaaatatagggtcaaagtaggagaatatacaaggtgatttcagtgtgttgcagtgagtggagtgtatcatgttttagggagttgagaa

SEQ ID NO: 8973 - DNA, 1169 bp, Homo sapiens
gcttttgcttatggtgtattttctacttggaccttcccctctttgccatctggagaaatagtccttgtcctttgaggccccgttcaaatgctcctggtcctctgaagcttttttttttttttttgctctcctctttcccggtggagttaacaaacagccctttcttttctgctccccagcacttcattcccattttagcactctctgaccactgtgttatcgtcaggctcgggtgcctttctgcctttcctgcccacctgtgagctcctcgaggggacagatgacatctgactcattttcatgtcttcctcagcagatattacaaattctccaaaatacttgttgagttggtatagattgttgacttcctaatcgaagtctttttctatttgtattttgagtaggacctgtctgtgttgtcggaagcaaaagcgctgtagggaaccatgtgatgcaggtccctgcctgtgcctgccgctgataagggcaggctgtgatcgctcaggctcatctcccgtgtctggttccccttaggagtaaaactgcaactttcacggatgccaggatcaggaccatgaatgaagttataactggtataaggataataaaaatgtacgcctgggaaaagtcattttcaaatcttattaccaatttgagaaagtaagtttttgtatacattgtaccatatttttgtatttttctatttgctattcttgttgatggttttagaagttttactatgttttcacattatgggaagttcagtacaatccatcccagtccccacgcttggcagttgggttaagtagaatggtagagaacgttattttcacttggtcttccatttaccatgttcttaaacagaaagcatgtatgcttcttactaatacaaaagtgaaattccaaatgtttctgaatatcccaaatcccaacaatgagtctaagatgttagtatttgagaataatggtgtttaaaataaaactataatttatattaatgtagccaaatggacaagttatagagactgggcatatctatattggaccaaactatatgaatcagtatttttcattccaaacaggcatggaaatactgttagttgtgctttgttttattagaaattttggagggggctgggcgcagtggctcatgcctgtaatccaagaac

SEQ ID NO: 8974 - DNA, 1184 bp, Homo sapiens
tgcaggtgggggtactgaagggctgcagcttaaggtggagacccaggctggagatttaaatctgggaatcactggagtagagctggtctggctgaggtcacctagatagagaatagaaagtgatgaggtcagccccaaggtcttcccaatgctaggagctcagaaagagcagcagcagagagtgaggaatagtctctagcaaagctggagggaaacctggggagtgtgttgtcatggaaaccaagggaaaagtatttcacagaggaggcagtggtcagtcatatcaaatgccgctgaggtacagagtaagatgaagactgacaatggacggctgttgtcaagacggttgttggtgaccttggcacagcagcttcagtagacagatggggacaaaagtctgattcccctgagctgagctgagtatcatgagggagtggtcctactgtatccagacattggtttcaataacacttattgggaaggaaagcagagacatgaggcttcatctggacagaaatgtgagacccagggacaactttgtttcatttgatgtgggagatactaagatgtgtttgggtgtgcaccaccgacaatatagatggtatgcaaaatgaagacgcaagagaggggaggggactctgaggcttaccaaggagccaggttttctgccattgaagtattctcaaaagcaaagaatgtaagggctctttctccatgggcagatcaaagcttcctgcagattgccacagtaacccacagaaattcttatttttatcgttttttgtttttttttttgagatggaatctccccctgtggcccaagctggagtgcagtggtgccatcttggctcactgcaacctccttctcctgggttcaagtgattccgttgcttcagcctcccaagtagctgggactacgggcactcactaccacacctggctagtttttgtatttcttttttttcttagtagggattggggttttgctgtgttgcccaggctggtctcgaactcctggcctcaagtaattcatcccccttggactaccaaagggctaggaatacaggcgtgagccactgtgcccgacctcattctgatcttaaatgttctcagtatctagacgtgggtacttggcttatatactcagtacctgcatttccctccagtttgggccaggttgtttc

SEQ ID NO: 8975 - DNA, 1227 bp, Homo sapiens
tagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaa

SEQ ID NO: 8976 - DNA, 1303 bp, Homo sapiens
ttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagtatttccttgcttttgattcatttttgtccttgagtataaaattctaagaaagtccgtcttaggaaaagtctattatttccagctttgcttcacgcaaaaccagtgactgaggtgacaaaagggctcttcctttacacaagttgacagggaaggtca

SEQ ID NO: 8977 - DNA, 1145 bp, Homo sapiens
aaatatttgctagctgggtgtggtggtgggggcctgtagtcccagctatttgggaggctgaggcaggataattgcttgaacccaggagggggaggttgcagtgagccaatatcgggccactgcactccagcctgggtaacagagtgagactctgtctcaaaacaaaaaataaaaataaaaatagttaactctcatagaccattctttgtcttttaaattcagactgaggcctaaaacaccactgcagataatttctttgctttgaaggttttattctccaagttccttatgtgtgctataaagaataattaatgtaatgaaaaaatcaatattgtgtataaattatttaggctttactatcattgtaattttctcttcaacacctattgatcggcaacaattcatttgttaatttcttcctaataagatattcattgtattaggtctgtagtagtgctgtccctgcactttcgcaagcaagtcatgaattactaatgatacatggaacaagttaacttactagtgagtggtatgagatggaaaacaggcaaagggagtaatttgaaatgcagtcctatagaaacactgtgtaggcagacaactgctaataattcagtgagtatactcttgcaggatattaatttgtactttaaaattttatcggtacgtgtttttcttggcatatatgtgttttctttttaaaattaattttaaaaatccatgattctctttttttgagaagggggtggaggggccggttttccctaaccatttacagtaatgccctgaaaatgatggttattaaacagtgttttgaccgttgataacagagttacttcagagtttagggaaaatctgagacctttttaaaacctaaagagagatgagtccaagaagaaatcaaactaccaaattcatggcaaagagaacttctgcattgcataatttggcagagtggtatccagaaaagacctctaaatttgtaatcaggcaaccaggatttgaatctgggcttcctcacttactcgttcacttatttattatatcatttcctgccaacatatcagtttcctgaggttggtgagtttgtggtctcctctgcattatcagtgcctagagtagtgcctggtacataatggctgtca

SEQ ID NO: 8978 - DNA, 1133 bp, Homo sapiens
aaatgtgaacaaattttcagaaaatgaggatatttttagtgcccatgatacatagttcttaagtatttaatgaatcacaaaagatttagtatagattatagatagcggaagccaagattcagacatttattacctggagtagaccattggcttacaaaagacagatatggacaagaacagagcagccactgacctaggtccagatctggatgttccactctgatttacagtgttttcttgattaacaaatccctgggagggttgggtaggggaggagacaggttttttatgacagttattgaggggtgagggaatttgctgcaatggcagccacatgcctgttctcaaaatggagcctggcctcctgggttgtggggaccactctctggcccaccttccagggctaggagccagccagggtgagggattcacctctatactccttcccactcctaggtatatgagaatgttggagaattaatggcttcatctggatgaacatcatgcctggaaaacaaactcatgcctatgattttttttttctgttttaatctcagataatgcagtttcttatagcaaagaatgctgcgaatgcatcttccatgtttatgcaggtatcactatgcctccctggactggctgtgcaaataccagaagaggtactgaagtgaggtaatgggtgagatctccagaataaagattacagagggactgtgccttctgttcacatagagccatttttaactagctttcactgaaaggggctccagagcctgtaaaaccaagtgccaacttctcccttgctgcagaaaaccctgatttctaggaaagtgttttggctggccctggcttgtccatacttgggaggcaattcacacagcccgtggaccatagcaaattagattgcttgtatttctggtactaccaaataatgaacaacctggtctctctttaaagttgttctgtctataaagtggagcctggccctcatgaatggctgaaaacaaagtatctaatcaactctgagcataaacgtatgtaacttctattcaagcccttttcccagttttattttacagtgcagggaagtgaactctggggatctggggagatgagaggttttgcagctctcc

SEQ ID NO: 8979 - DNA, 1124 bp, Homo sapiens
catttagtaggctttatagtttatttctatttttaaaaatctgtaaggatatttctctttaactttatagaaaatgtttctcatttgaagaaacgtatgtgaatgtccctgagtctcagaatacaataacgtgaataaaccattgaataaatagttgacaagtagtgcaaagtacagtattcatggtatttatcactagacatttttatatgacataagcttaagtatttattaatcatatgcatggattttattttcttactaaggttctccatacagaatttgttcctcattgactctaatagagaatttcattgagtgttttttgtagagacagggtcttgctgtgttgcccaggctggtcttgaactcctggcctcaagtgatcctcccatctcccaaagtgttggaattacaggcatgagccaccacacccagcccattgttgagatttcaatagacagaggataacattgaaaaatatacctgattgttgaggaaccagggtgttaatagataaaagtcatgtgtcccctcttttacttttcctcatacaaggtaggctcactataaatatttatggaatgagatgagtacatatgagcatttcttcttcgtgggcagggaagaggcggaggagaagtctttgcattgtgtaaattgtataaggtggaatcaaatcaaattgaaattttgtttgccacaactgataacattcactgaacctaactggactagtgctaggaatagtattagaaacagtctttataattcttatacactaatatgctacgtacttagatacaaagataaaaagttaccatccctgtctgtgtggaacttagactgtttaaccattatccttgaccattgtgatggtattgatgtaatactatatttggattaccacagtggaacatatcacatggagagaaccctctctcaacagacatcatctgtcactcgtactaaactctcccaccattggcttctaattcattatggagtagagtttaatatttggcccaatgttaagttgggtcaattgttaagtctactagagttagcatagtcacaccaacagttccgcctgggcaagagtagggagcctcaggatttatatt

SEQ ID NO: 8980 - DNA, 1106 bp, Homo sapiens
gatcacccaaggtcaggagtttgagaccagcctggccatcatggccaaacctcgtctctactaaaaatacaaaaattagtcaggcatggtggcaggcgcctgtaatcccagctactcgggaggctgaggcaggagaattgcttgaaccctggaggcagaggttgcagtcaaccgagatcgcgccattgcactccagcctgggtaaaaaagtgaaactccatctaaaaaaaagaagaacctctgttaatatctgattatctaacccaaatacagagttgtttggtttgttggtttgtttggtctttttttttttttaacatgattgtgatgccatttttatggctaaaggacagaattttgtggagtttttaaaaatagcaaaagtgacatttttcactactccaggtttgaatgaggcttatgaaatgaaaggatttactcctagtatattgaagttctgacttacacaactttatgtctggatttctttactttcagatgaggatggcaataaccagtggcccgaaggtttgaagttcctttttgattcagtcagctctcaaaatgtgggactgcgggaagctgcccttcacattttctggtatatacattaatctagttttttgagacatttgatttaatgaatgccctaaacaccttttaactgattattttagcctaatttaaccttatacttaaaatgataataatgcctttacataagttttgtttgtatttgtattggaagcaattttttttaaaagggccttttatttcacattatgatcttttttgtacacaaaggttctctacagcttgcttgctttctctttgtcttttatgattctgaaagttttattgaacagtttcctctcctttatttggagattaacacaatactggatgtagcttttcaaaagccacattaataatggtgtcttgaagaggagaaggagaatgcaggtgaatccccattatgttttctgggtcttgtgtgacccaattttataatatgttaagaaacctgtatatttataaccaaatagtctaagtttagaattaagtgattattctttgccccactgtgctatatttttttactacac

SEQ ID NO: 8981 - DNA, 8554 bp, Homo sapiens
agccttaagtattgtaatggttattatagtttcactgattttcattttgacttagatgtaaatctgttttgaatgtttctagttaacatccatcagaaggaaggtatacatgtgcctgcaggtagaacatttgcataatatagattgctaaattatttagtgaaaaatagtttagtaatatttctctattgtcagcatcttaggaatcttttggctaatgaggcattataaagtgaatcttcagcaccgactttctgtttcatcttttctaggcggtaaatgactcgtgctaccagaatgatgattctgtcctaaaatccctcgttgagattgcagatactgttccaaagtatttgcgtcctcacttggaagcaactctacagctaagtctaaaggtaaattaagtacgttagtaaacgttctgtttgttattttcagggactaatctaaattattaaatgtatacaaatatgtcttctttgtagttgtgtggagacactagcctcaacaatatgcaacgccagcttgcccttgaagtgatcgtcaccctctctgagactgcagctgctatgttaagaaaacataccaatattgttgcacagactagtaagtcaatggtcttcagatagtttatgtgtattgtggccaaatttttggataaatttgctgagggttgtgtgatttctcagattgttgagaatataatgaatatccttttagaatcagatgaatttgggaaaatgcatctcaatacatgcaagcgtggacccccacattgtggttatgcctttaagactttgcagacaccctgaaatctggtgttaaaaataacatttctagagtggagtgtgacagactctatcatttatatgttaatattgggcacagttaatagagtcaaaaacaattcagcggggatatatagatgcacagtagcgaactacaaaccaaaatagcatgtcttgcttaccagtgaagccaagattagaagaacaaggtctaacactagtcatggctctgttcactatattacattgcttttgttttatagaccctcgttgcagcagaaacttaaatggctattgtgctatggaaatactactttaagtttcattgtgctgggataaggacttgagaactaacctgatcattttctggcctagccatttcttaatgagctaatgagtacttgaacacttaatttagagggtaaatacgtcaccagatttattttgtagtggtacctaccttttgtcttacactgaggtagtggttggaattttagaaacattcccatttaagtcaggaacaagaaaaatatctcctttatcactgttcatgttgtactgactgccccagctgatgcattaagagataaaaataagttataagcattagaaacaatggctgggtgcagtggctcatgcctgtaatcccaacactttgggaggccgaggcgggcagatcacctgaagtcaggagttcaagaccagcctggctaacatgctaaaaccccgtttctactaaaaatacaaaaaattagccagatgtggtggtgcacaccggtaatcccagctactcgggaggctgaggcaggagaattgcttgaacccgggaggtggaggttgcagtgagcccagaccatgccattgcactccagcctgggcaacaagagcgaaactcgtctcaaaaaaaagaattagaaaacaaaaatattgcttatttgtaggctatgtggttattgtctacaaaaagttttaaagactcaacagataaactgctaatcaaagggttaagcaagatccttagatatgagaacattttattgtaagtgttccattattcataataatcatttagaaaattttataggcatgagttatagtaactgggaataaatcaaaagatgtacaagacatatgggaaagttgaataacatattgaaagactaatagaagaacaaattatcagttctcaaattaatctagggttatgatagaacaatcctgaaattcttctgaaagaacatagggcctggagtagccaagacaattttgacgaataaagtggagatcttgtttcatcaactctgtgaatttagaatgcattgatgatgcaggtgttgacaatggatcggatggaacaaagggtagagtgtaggagaagatccgctcacatgggaacaaagccatttttaaaaagataattgatcaaaagttcttggggccaggcatactggctcaggcctgtaattccagcaatttggaaagccaaggtgggtaaattatgtgagctgctgagtttgagaccagcctgggcgacatgacgaaaccctttctctgccaaaaatacaaaaattagtcgggcatggtggcacacgcctgtggttccagctactcaggaggctgagatggaggattgcttgagcccaagaggtcaaggctgccgtgagccaagattgcaccattgcactccggcctgggtgacggagtgagaccctgtctcaaaaaaaaaaaaaaaaagtttctgggatatctttctttcattctttctttctttgttttttttttttttgtttgtttaataggtttatggggaacaggtggtgtttggtttagtggtgatttctgtgattttggtgcacccattacgggagcagtgtacactgtacccattgtgtagtcttttatccctcactcccctcccaccctttcccctgagtccccaaagtccgttgtatcattcttacacctttgcatcctcatagctcagctcccacttatgagttgagaatataactggttatttctatggggaaaaaaattccaactctagacagcttattaaaaaaacaggccgggcgcggtggctcacacctgcaatctcagcactttgggaggccgaggcaggtggatcacgaggtcaggagatcaagaccatcctggctaacactgtgaaaccccgtccctactaaaaaatgcaaaaaattagccgggcgtggtggcgggcgcctgtagtcccagcttctcgggaggccgaggcaggagaatggcgtgacccgggaggcagagcttgcagtgagccgagataccgccactgcactgcagcctgggcaacagagcaagactctgtctcaaaaataataataataataataataatttggggtctactcaagacctgaatattaccttgcacgctggaactagttaaaaaagttaagggctaaatattacagatatattttacaagtaatgcttaatagtagataattttctaagactgaatcacaaaccattgatgtaaacattgccaaattggcaaatgcgaaaacaattttttgaccaatcagatacaccataaatgaactgaaaaaataagccacaaactggaagaaaataattacagtgcacacaatcaacagttttgttatctagagaatacacaaaggctgagaagaggaaattcattgcttttttcttctttaagatggggtcttgctctgtcatccaggctagagtgcagtgacatgatctcagctcactgcagcctcccaagtagctgggactacaggcacgcactaccacacctggctaatttttgtgttttttggtagagatagggttttaccatgttgcccaggctggtcttgaactcctgggctcaagggatcctcccacctaagcctcccgaagtgctgggataacaggtgtgcaccagcaggcccagtcaggaaattcgtaaaagagggatctgaaatagctaatgaaccctgctaagtctcaataaaaacaagtgtaattgtggaatacaagttgtccagaagtttgacagtatcaattgttaataaaagatgtggaactgagaggacgcttattccacccccagggcacttcacacatttttgtgaaataacggagacctccacttaaacttcacatagtttatgcaacagctgtgcagagcgcagcttgtttggtaattttctttttttctttttttagacagagtctcgctctgtcgtccaggctggagtgcagtggtgtgatcttggctcacagcgagctccacctcccaggttcacgccattctcctgcctaagcctcctgagtagctaggactacaggtgctcgccaccacacccggctaatttttttgtttttggggtttcaccatgttagccaggatggtctcgatcttctgacctcgtgatccgcctgcctcagcctcccaaagtgctgggattacaggcataagccaccgcgcctagacttgtttgataattttttagtactatttgaagatagtaataacaatttcatgcctagactcatgcttgtcaaagaaaagatgtaataatctcatcaaagcaaattttataggaggaaaaaattggaaacaaccaaaatgtttatcagctagacagtgggtagtatgtttatataatggaatgctattaaataaactgaaatccttatgtgttgagaaaaaagcaaattgccgaggtacatatattatgaaaccatttattatataaaaaatcaaatcttgaaatagtactataattttgtatagagatatggaaatctgtagttcaagtgtgaaaaaacaattgcggaatgagaaacatttgtgatgttgcttcttacctctggtgatggggagaatgtaatcggatttgggaatttcataggagggtttgacttaatgaatgttgctttttaaagaaacgataaaagcaaatataacaaggttaaaatttaacaaaccaggttttgggggcacagacaaataattgttttgtcttgttctcttacaggcaaagtaaaatcttaaaattcttgtttataaatagtgatatggataagataaagtcacagtcttcgggtatgaaataattgtttactttagttcctcagatgttagcaatgatggttgatttggaagaagatgaggactgggcaaatgcagatgaactagaagatgatgattttgacaggtaatcaaacattgtgtccagggtggcagtgaaagccctagggctccacggtccatctcttcactattgcaccctgtaacctgaaggtaaacttttaagcctggaatatggggcactttgccttgctgttgtatttattgctgtgtcacatgttataagtagtattttctttagttttcatgtataatttatattaataaaatttatgtttcttggaagttcataaaaatattttaatagttaatacataaagttgtattttataatcaggaactgaaagatacctacaacaacaaacaaggaagtttttcttttttaaaaaaaagtatgacatgaaaacagcaaataaagtagctatgttttttgtttggttttgagacggagtctcgctgtgtcgcccaggctggagtgcagtggcgcgatctcggctcaccgcaagctccgcctccggggttcacgccattctcctgcctcagcctcccgagtagctgggactacaggcacctgccaccacgtccagctaattttttgtatttttagtagagacgggatttcaccatgttagccaggatagtctcgatctcctgacatcatgatccgcccgcctcggcctcccaaagtgctgggattacaggcgtgagccaccgcacctggccaagtatctatgtttttaactgtcgtactctaaattatttccaagttttttgttgtttttgtttttgtttttagtttgaatatcttttaaaacgtgtataaagcagcttttttgtgataaatgcttttacaggcagagacttcccttagaataattgtttcaacaaaattccctgcaatacacatcatattttcctagtaaaaagcagtttaactttaggataggcagcatccagtggtgaaaagatgagagtcaactgggtagagtattactattgtacttatttatttcagcttaggaagtcccatgaatacaggaaaagtcaaccaaaatctgtattcactgtgcagtagtaatgatggccccttacatgtatgtgaaacatagcacctctgagctctgttactttaatcaactttattagcagtcccagaggtgtattatattacagttgcagaaagggagattgaagattgagtgatttgtctgaggttatgtagccagttaatggactggggttaattaccattgttttcattcttcccagtgcattatactaccaccttttctttaaaaaagctgaaattggctgggtgcagtggctcacacctgtaatcccagcactttggtgggcagaggcaggcagatcacctgaggtcaggagttcgagaccagcctgaccaacatgttgaaaccccgtctctattaaaaatacaaaaattagccgggcctggtggcagacacctataatgccagctactcgggaagctaagcgaggagaatctcttgaacctgggaggtggaggttgcagtgagctgagatcacgtcattgcgctacagcctgggcaacagagcaagactccatctcaaaaaaaataaaaagctgaaattattctcctgaaagacttggagtcagtataaactactaggttaataaaagtaaaaattaaagatttttggctttagaatatatatgcatttttgagacttaatcccattgttaaaaatgactgatttctggctttaatactgtcttgaagtatatgaaagtaatctttcactggaaatcacctgataacggctgaagagaagaccagggctaggtcgaatttcctttttggttcagttactgtaatgtgctgctacctgtcctttcatttgccctgcaaatggcacttaaatttatacagtttaagaaactttgttttctaaactagatgaataagattttctcatttgtgaaacagcataaatatattttcagggtgagatttttttaagtctaaaaacctgttctgaagataatttatagtttcatttttatagtattgtctttacatagtaaagataatgcacatgaaatacactactgatcctccagttctaagccaggataagtccaaatgcttttatgcccacattcctttggctttcagagaagacaatagaattgagtttcacatagctatgcatagtttttggcagtgcagtttgcacccctttaagggtgaataaactcacagtggggaagattatacattctctgcacccttttcagttttctatgttctgttcattgataggtttgaagactgtatttctaggaaatgaaatacatgaggctctttcaatactgcttttactggagtgttgaaagtgtcagaagctatttctgagaacagtttttagccagtagcgggtgggggtggtcttgaaaaataagattcaggctgggcacagtggctcacgcctgtaatcttagcattttgggaggcccaggcgggcgcatcacaaagtcaggagatcaagacaatcctggctaacatggtgaaaccccgtctctactaaaactacaaaaaaattagccaggcgtggtggcgggcacctgtagtcccagctactcgggaggctgaggtaggagaatagcatgaagctgggaggcggagcttgcagtgagccgagatcgtgccactgcgctccagcctgggtgacagagcgagactctgtctcaaaaaaaaaaaagaaaaataagaatcaggcatgactttctaaactatggtggatcatgataaaaacatttactcttttttcttttctaagctgcagagtttttaacccctaatttcaattccacatttaaagacagcttgaattctttctcagtcttagtttaataataatatggttagaagtatgtctgtagagtatactatttcttttgtgtttcagatatattgagtacataattctgtttatgtgtttagcaatgcagttgcaggcgagagtgctctagatcgaatggcttgcggacttggtggaaagctcgttctgccgatgatcaaggaacacattatgcaaatgcttcaaaatcgtaagctgtgtccttcaaatgctagaagagtgaagttgtgccctttctaaagcttaaattctaagatatgtttagactgttaaaaattaatctttgtctttttatcatccatatttaacccaattcatttattttaccgataaaattgtcaatcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggcc

SEQ ID NO: 8982 - DNA, 1174 bp, Homo sapiens
gatcttctggggagagggggttagaagataaaggaaggggccaaagagggaattttctttatgacgtagtaagacagcacaaaatataatcataagtagaggaaatcagtgaagaaaaaaatgaggatgaagtgtaggcattaaagttgatgaacacaaaaattttgattccgtatctgtactcaagaattagctgtgctttgagatgagactaacatgagttagaggtgttgtgttaatagaagagagaaaaaaaaaatctcacataaatagttcaacatagattctttttatagaaatttcctccaaaacctacagtctctgcttctggagaggtggtctcattctgctgtttcagaaaagcattcaagaacttgaagggagtagtaattgtaaatttaaatacttcttccagttttcctttgaggtaataatttgtgtcttccttctagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaagtaagtaattttttttttttttttttttttttttttttttttttgagacagagtctcgctctgtcacccaggctggagtgcagtggcacgatctcggctcactgcaaactctgcctcccaggttcatgccattctcctgcctcagcctcccgagtagctgggactacagacgcccgccaccacgcccggctaattttttgtatttttagtagagacaaggtttcactgtgttagccaggatggtctcaatctcctgacctcgtgatccgcccgcctcggcctcccagagtgctgggattacaggcgtgagccactgtgcccggcctgtaatttctattatgttaaatttactgtacctaacttggctgtggaggcattgagagtactagagggattttttccttctgaaaaatggttttctggatgcttgtttttttccttactcctttcacattgctcctgttttatatacaaattcttgccttcatcttttcattgtttgt

SEQ ID NO: 8983 - DNA, 1132 bp, Homo sapiens
tagtttcatttagatgattcagatgctaagaaagaaaaccattatcacttactgaaagtagaaagaaatacccaaggttctggtctttgtgttttgcctcacctgctgtccatatcccagtgtagtgagttcacagggatttcattattgattctgaaccttttaagtacataacctttagaaatgctcttactgcttaaagtactgtgaacatatcaataaaacattgtttctatgaaataaggaaatggctttctttatcacgtttacccattgttttttaatctattttaattttaaaatttttccccagatctcttacatgatctcagcatgggccagaatgtgcaaaatccttggaaaagaatttcagcaataccttccagtggttatggggcctttaatgaagacggcttcaattaagcccgaagtagcccttttagatagtaggtgtctttagaaggagctatcggttataatagttctctctttgttattatttttcatatgcatttgttttcttctccgttaatagcccaagacatggagaatatgagtgatgatgatggttgggaatttgtgaaccttggagatcagcaaagctttggtattaaaactgcaggactagaagaaaaatcaactgcttgccagatgttggtaagagagcactgtttttactaaacttttattttacatcttatatacatttcatatgagtgcttttaatagctgctaaagaaattactttggagagccagtaatatgttccttaaaaagtaaagttttctttccattttaaagaaatcgtatggataaacctttcattatcagtgctgttttaaatagcaaaaaacaacaaatagcccaaattcctgttagtgggaagatgaattactgtgccttggagtaatatacagccattacaaaaagtttataagctacatgagggaaggatttttgttggttttgttcttagtctatagtaggtggccatggaatgttttttaaacaaatgaacagaagtgtgttcatgctatttaatgtgaaacaaaacttgtatgatttcaattgtgtaaaaaaacagatatggcaggaaaatcaaaatgttcggttattatcccttatggtgttt

SEQ ID NO: 8984 - DNA, 1215 bp, Homo sapiens
gctggtctcgaactcctgacctcgtgatctaccagcctcagcctcccaaagtgctgggattacaagcatgagccaccgtgcccagccatgattttttaaaaatacaaaataacagaagcgttttctacagatttacaaagtaaatgcttcaattaactgatggtttcagggttttttgtatcttttagaatgatttttcctcaattaagtgatacattttgtttgatgtattgctgaaacttgctgaatggaatacgaatgattccagcctttgaagggacaatatatacgacaataatttcctttttttttttctttttgtcactcaccaatactacaatcatttcatgacccttcttttaagactctttttagttggaagactaatttgacagttctacatgcaactttaaatgtagttctagtcaaaatacaacctcctgtggtccttatgattttgctgtttgttaatattaatgcttgaagactaacatgaatctttatttcctcccaatactttggttacaggtttgctatgctaaggagttaaaggaaggctttgtggagtacaccgaacaggttgtcaaactgatggtccctttactgaaattttatttccacgatgatatcctacaacttctgaatacaaaacatgtctagatttagtaaacttgtagtttcttggagtattagacagtgttgactgaagtagacttcaccatgattgtttgtatttgcactaagtgtactcttaggtgataaactcggttctctgcatgtgcctttgtttccacttgtgccaaaacatgaaaaagaaaacgtgacctatcctatgtttgtcagctttctgtggcccacttaaggatttaaggataattagcaaatgattacaattatatatagttgctactttccccaaatatcttttggtaaacgttaagaaaataagacttttattttaagagatggtgtctcactctgtcacctaggctggagtgcagtggcgtgatcaggacgcactgaaaccacaacttcccaagtagctgggacccaggtgcacaacaccaagcccagctagatttgattttttttttttttttttttttttttaagagataaggtctgcctatgttgcccaggctggtctcaaactcctgggctcaagcagtcctcctgccttggccccacaaagttatgggattacacacctgagca

SEQ ID NO: 8985 - DNA, 1148 bp, Homo sapiens
cctcgtgatcggcccacctcagcctcccaaagtgctgagattacaggcgtgagccaccacacctggcagaataggacttttaaaacttactggggaatatagttaggcagcttttaaagtttaaggaccctcgggtgatgtgatgagtactgtaaatctggaggccactaatctctctgggtctctaagttagtagagggctagtgctcctgtccatgctggggcagtcccccctctgttgccattctgtaatgacatagccaagaagacaacacttcccatacactttaacatttctttaccataatcaatatctgaaccaaatacaaaaatacatatattcatttgcatgaaaatgtgaggttttagctgaacttctttcaaatgcttattttagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaaggtaggaaagcagactgtgaccttatttccttctcctccacagtgcttcctggtttttcttgcctaacatcagtcttttaaggtttaaccacatgatctctgcacagtcctcagttgtataggtttataatagtgctgtctttataaatcatattaagaaaccatatcacagttaacattgcccttataataaggtctaattttgagttattctttatgaaattagattcaacagatgaggcactttaattatttatttctttgtttttaaatttttttggtagcgacaaggtcttaactgttttgcacaggcaggtcgcaaactcttggcctcaagagatcctcccacctcagcctcccaaagtgctgggattacaggcatgagccaccaaacccagcctaagggaatgttgtttagtgtctgttttctaagtccaagttccccccaaatatcagtcagatctaagctctgtcgctattattatttttaggttatgaataaattcaagggctacaaccactg

SEQ ID NO: 8986 - DNA, 1895 bp, Homo sapiens
acttcctatattcatgtggtatatgggttactttaagatgttacctgcttagtgtagctttttcagtgcaaaaatgaagaaaacttactggaaatgaaatgaactttaaaaaaatgaacagatttcttgcttttacaatgatactcatcaaaataatgtacctagggagaaggtattttgccatgattacagtttacctatgatgatgattaaaatccttccaaatgagcatttcgtcctaagtctgtgaaaatgtttctttccctagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattgg

SEQ ID NO: 8987 - DNA, 1205 bp, Homo sapiens
acaggaatcgtcaaatgtaagcatccccgagcaaaacacgcttcaatcattattttgttttgctttttcctacagcagtgatttttatctaagtattttaagagcagttgatcaatggcagtatactcagttgtgtattgatgagatttttcactttaagagttgctcatagagtttttccctcactggctttgtaccaggcaagcaacttaatttctgcttcttggccagtattcacaaaagcagcaatcctggtgtaattaatggtgcttacagtttgtttaaaggctgtttatcatacatcctgatgtgctgcgaatagtcactacttgcctcaagaggagcttgtcctatgctaataaagattctataacattggccaaagggtccgtttatacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctccttgtgctaatatcttttgttggatattatttcaaaatatgtgaattttagacccttttgtggttgcctttgctgccgcttgttaagggcaaaataaaaacgcaagaaattcttttagcatgaagaaatacatttaatgagctccagaactcaaaataaatggcttcagctccttgaacagtcatctgtatgccattgacaatattttattagataggcgtttaattagaggaagtctgtgggccagattcttccctgcatgtgtgattcatatttggaaatttctgatttatctccccccaattgtgccat

SEQ ID NO: 8988 - DNA, 1164 bp, Homo sapiens
cacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctg

SEQ ID NO: 8989 - DNA, 1098 bp, Homo sapiens
attgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctg

SEQ ID NO: 8990 - DNA, 1081 bp, Homo sapiens
tcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgtt

SEQ ID NO: 8991 - DNA, 1106 bp, Homo sapiens
agggagtctcactctgttgcccagactggagtgtagtggtgtgatcttggctcactgcaacttctgcctcctgggttcatgtggttctcctgcctcagcctcccgagtagctgggactgcaggcgcccgccaccacgtccggctaatttttttgtatttttagtagagacggggtttcaccgcgctagccaggatggtctggatctcttgacctcgtgatctgcccaccttggcctcccaaagtgctgggactacaggcgtgagccactgcacccagcctggaacccttttaaagtgataaacacctcagtactttttacatggcctgttgcatagatgatttcttaatattagctatagcaatcaaatgagagtgtttttgaaattccccgaaaataattcttcttgagtttgtcattttatgtcagagtagtagtaattccgttcctttctgctggaggacttgtgatagtaagggcctttggaaaccagcagaacagccagttgcttatcggctgtggtgtgcgagtcccgtttcctaccctggccccgttatgcgtacatggtctataaaagaatcatgtgaagtggggggttgaggattgtacagaaatgggaaccttcacccagaaaaatatcttcactccatctccgttaaagtatttttaaagcaaaagcatctagaatcccagtacttgagtatgtagttcttcctattttatttgccagttgtctgcgtacacacatttccttaagtaattgcagtcataatgtaggtacacgttgatattgttcctcattcagcattgtgtcataaatatcatcccacatttccatatggttttcatgatgattgttttactgtcttaactgacttctgtgcctcctttaatacaaggcgtgtcacatctttttttttttttttttttttttttgagacggagtctcactctgttgacccaggctggagtgcaatggtgggatctcggctcactgcaacctccacctcccgggttcaagcgattcccatgcctcagcctctggagcagctgggattacaggcacgtgccaccacacctagctaatttttgtatttttagtagaga

SEQ ID NO: 8992 - DNA, 1222 bp, Homo sapiens
tttcactctgtcaccgagactggagtgcagtgacacgatctcatttcactgcagcctccacctcctgggttcaagcaattctcctgcctcagcctcccgagtagctgggattacaggtgcccatcaccacacccagctaatttttgtgtttttagtagagacgggttttcaccatgttggtcaggctggtctcaaactcctgacctcaagtgatccgcccacctcggcctctcaaagtactgggattgcaggcttgagccaccgcgcctggccccatttattgtcttagtagaatagtactttaatgtgttatatgaaagtactgattccttttgtctccctttaaatagagatagaacttgtgcttaaatagctgtgtgagtgtacgtgagctaccttaagctatgggaagtagatgatattaggcttacaggttgcatattagaagacaaacctaacgttactcagaggtttttgtggattgtgagagttaaaagcactttctaaactgtgaggttggaaggtaaacccattccataagtaatcccattatcccaaaacaaagttataattcaaataaaggcgcatctctctaggccacagggcgctcggtcacatgctttgctgacatgtcttcttctgccctatctagttgtgtttgtccttggcagtgggatgtacaagaagttcaagccacagggcaacatcatgggtaaagtggccaagtgcatcggtgtaagtatctcagctgctctttctcaaggctatttaaccacctcagaaccttctactttctttaaattaaaatttaagctttgactttcctttaaatatatttttagtgttcttaactgtttcagtaaattgtagcttcttctaaatgcaaaaagacacaaacagaacttaataagggaagaatagaaatggctcttgagcttataaaataagatcaatggtcaaagaaaagcaaatcaaagtgactcttcatctgtcgaaatggcagaacagtgcttgaggtttgtcagggagcagtgaatcaaaaatggggaggctcaatttggcaatgtgtagcaagagtctcaggtgttcagttgcttcaagtcagtcatgctgctttcaagaattaagagtaagaaaataggctaggcactgtggctcatgcccgtagtcccagcactttgggaggcctaggcgggcggatcacttgatcaggacttcgagg

SEQ ID NO: 8993 - DNA, 1155 bp, Homo sapiens
cttgtaaattttatcatctgttttacccctaagggttcattcacctaacagatctgtacatctggaaccagtgagggtatgatcccggatttccatgtgagatgtcctctcctgaggaaatgctgtggataatcctcctcagactaacaataccactggatgctttatttcattgctgtctctatgtggaaggattagtgtagggaataaaatgattaaatgctagtttcctgctctagacagtcaccggtaagttactgaatctgcgttggctgcctttcatgccactggtgctcctttgtggctatggaccagtggggggtgtatttcaatcctgtgcttgtttcttttttgtcagagtttctttggttatcccctgagcatcttcttcatcgtggtcaatgagttttgcgaaagattttcctactatggaatgcgaggtaactgtattggccgtttctcacccttcagggaagagcgggagtggccataaccagtcctaactttgtttccccctcctcttccacctgccctctgcaaaagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagtgagtggctggaaatttcttgttcacaaacaagcgaaaaagtaaatgtaggttttgtagttgggaatggtggaatctgggaatgatgaatcaaagaacagaaactcttaggagaggccaggtgtggtatggttcatacctgtaatcccagcactttgagaggctgaggcaggagtttgaaaccagcctgggcaacatagtgagacccatctctaccaaaaataaagaaattagcaaggcatagtggcatacacctgtggccccagctagctgggaggctgaggtgggaggatccgcttgagccccagaggtcaaggctgcagtgagctgtgatcacatcactgcaccccagcctggatgacagaacaagaccctgtctcaaaaacaaattaaaaacagaaacaaacccttaggagagcatttacagcgctgtttctgctcagtatcctgtccctagagcctgaaacagt

SEQ ID NO: 8994 - DNA, 1129 bp, Homo sapiens
aaaccaggagtttgttatttttagtttttctttgccatttagcagcagaaattcaatccccactgataaacagaacctgctggacctcctttgctcagataatttctataacacagaggttaactcactattggttgaaataaatgcttaaactttgaagcactttttaaaaaatcataagtacaccagtgctgcacctccaatgataatcatttaggaaacacagaaaacaaaaattaaatgaatggtccacatgtgaataaataaccttaatccactcggatatgcagcagctcttcccactgcaaatgggttttgtggtggtaacttgaattggaggagagagacagctggcctggtgctgctgctgctgccaaaagccatcttgttaacatggtttatttccattctgtcttcctgctacccacaagagccctgtcctcctgtctccctcctctttcatcagttttcagtggcatactgtcctcagtcacatttctcctgctttgccagtaaacagcatgtagctgattcttctagtcctcgcctgcattcctacaattcctgctcattccgaattggttctgttatctcctaagttgttgcaactcctagaactcagccttcttttacatctccaattctcattatgtgtttgaatggcttcagcttttccctccgctagctctttgagctccaaatcatcaactcagacaaaaaacacagagaagggagtgcatactgtatgtacatgaacatgtttgtgtgtgtgttttatatatatgtacatgtttgttttcatctctacctgggtattttttgggaaatttatggccatatgtctttaaaaaaaatcccatttaacaacaaatacaataccttctgttgggccaaccaatatgacatagatccaatatgtgagaaagttgccagggaaccccaggagtccaaaatgattttatttcagaagagaataaaaataggaagagtccctgtacatctgcattgttcatttccgctatttctgtagagtaggaaaggctttgtcagaactcagcttgaccagcagggagcagcagaggcccatgggaaacggaatcctttgtaggtctgtccccatcaccactgg

SEQ ID NO: 8995 - DNA, 1203 bp, Homo sapiens
tgcttgggtaagaataaaggtgttaaaactcatataatcccttcctttgcatgtttgttctctgtgtcttccaatgcattttttaattaaaaaaaatacatgtcttttgctttttcagaacatatataatccaaaaagattagtgacgttttgacagtcgtcagaacactaaccattagtactgcattggagtgatgctcacttttttcagagtagcatctctaaagtactttctaaaaataaaaaggtccctgctttggcctgatttttgcttctggatcatcaggtgctttgccgtgaagtgtgcaggagctgccgcctgtctgtgtctctggctgctccactgtgttcagtcagtgcatggccatctccctcgtgccatgttctggcttcactaacactccccgtctcgctgcagtgtaacacgtctaacttttgcttctatcccatttcactcatgttgcaggaaccaggaggggttgggacccatagttcatgatcgaaagtctcagacattgcctgtttcccgtaacagaacaggaatgatgcatgccagattgcagcagctgggcagcctggataactctctcacttttaaccacagtaagtcccatgacatgccatcgtaacagccagccatctcatgtgccatctcagaggggagagccctaggccacacctaccacatcaccaactcaatttttcttctagctcaaagcaagtaggatgaagagctcatggcacagttcccttccttggaggagcgtcctcagcatttgggagtgacacaatgtggaacgtgctcaactacagcactaaacctaaaagtgcctgaccctttctgcatccctaaaacaaaactcggctgggtccatagccagccgttctcaagaattctaaacataaaatttggattcatcacctagaaccgacttaatgttggctttcccctgcaactctgagaacattcgggatggatttctttcaccccttctgatcctgtgcatgtaattgatcaagcgtccacattctgacattccagctctgaatggatgttaatccttgcactactgtgaaaacataaagcccatgaatcaatttgtgagggtgtggaaaagcatccaataacaaagtgactttttctgtgttttcagtgtgagaaagatatcaagtgtgcttggaatttctgtagacaatggtaag

SEQ ID NO: 8996 - DNA, 1286 bp, Homo sapiens
agccctttctcatggtcttggccctaaaacatattttcagggcttgtgacccagtgatcagtggtcacccttaaagtattacagatacgtgcctgttttacatgagaggtaactgtttatgtgtataagtcatcttaataaaataacatgaaatttattagctgaattgggtagatactgcttttctaagttgaacctaacttaagctgatgcagaaactgagtcagaaaagttgctataattttaaaatataagaagtaaaagtgaaatcttatgtagcatctttatctcattttggtttgtcagtataagtttctgatttcctttaagctctttacttttagaaacgtgaatttacaatcccttatccaaaactgctggggccagatgattttccaaattcagaactttttggatttctgaaaaatttacatatagactgtatcccattacatcccagcagcatctctctataataaaaaaaaaaaaaagaatttctgcagaactattattgttcataataattgaataaatcataactaaaagtagctttatgtctattattttgggtcatattttggtgccaaatgtatttgcatgaactcaggaggaaagctggttttcagagtttcatgcattttggaactacagatgagagactgtgggcctggccctcagtggacgcttggctcatagtctcctgacctctgctgagttaaaggcgggagttatgtggtgaaacgagattcaacaccagaggagctcactagacattgttttaactacctcattaaatacatgattaaaaaaaaatgttgttagatatatatttttaaaaactacacacttggtgtgtataatccatatatttgagccaaaagagagagctccttatatagatgtaaatgaggatgaataagtaacttggaacagtgtgcatggtcttgaacatgttttctcgggcacactgccgtggagtgaatcactacctctgagtcgatggacgatcctgtcggtcgtgggcctctgcgctgtgttgctttagccagccaccaccacactgacagctacacaggatggggcttccctcacaggttaataaatttctctgggtttgaaggcactttccagaggactcccaaaaaccattctgaatgaatgaggatgtgacttatgctggtactagacataatgtttattgaatttgttattgttaacagataaataacgtcccgaaaataattttatctttgcatttccctaataatttttcatcttgcctgcag

SEQ ID NO: 8997 - DNA, 1148 bp, Homo sapiens
gccactgcactccagtttgggcgacaaagtgagactctctctggatatgattatatgaatgtatcagattatcatatgtactcccaaaatgtgttccctaatatgtatcaattaaaaaatgaaattaaaaatgtatttttatatatgtatgagttttgtgcatgctcaggagctaactggctgatttgatagaaacacacttctctatttctttacacttgggtagccattttctgaaaggtgttctatggaagttctggctgtaaacttggtctcatttaagagccaactggcaatgaagccctgctagggcattctgcttgtttccagtgtcttttgatcacttacatccccaggtcgatgttttgaaagtggatattagaaccaaatttcagagtttctggactttgtcttcattctgatttaaaagaagtgaattctcttgcttttcacgcatgtggttttttaaatcttaggaacaatcattctgaaagtgctttcctttttccctccagacaaggcgcctctgtcgaagagccttctgctggtccccagtgccctctccctcctgctcgccctcctcctgcctcactgccagaagctctttgtgtatgaccttcacgcagtcaagaacgacttccaggtaagctctgcctcattggcccctgagaggagagcggacagttttttttttttctttctagatttgctttttcttcctgctgttagtccctcaaagcccccaatttgtaagaaatatttattattaatatttcattaagtaacttttctagttattgatttttcagcaaaacagataataatgaagcaatggcagtatttccttttattaggcacatttgttttcagtttcactttttactcagagaagtgtaatttataacttcaagggaattaaaaacaatgtttaatctttttttaatgcccagtaggcatacttagctttgccaaaaccttgtctcaatttgaatatttgattagaggagctaggctctgtcagctgtatcagattatgaatttttgataacttttacagtggtggttaaacgaagtaagaaatttctcttgagtttctgctgtgggaaagagcagaagtgcttttcaaggtttctggactgatcttgttg

SEQ ID NO: 8998 - DNA, 1168 bp, Homo sapiens
ccatattgaaatgaaaattggtttttttgtaaacagttttgacctttgccacaaggctcacatgaagaacatttggggcccagggataagcggcaatgtcagcgccctcaggtttctgcgttttctctgcctgcaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgc

SEQ ID NO: 8999 - DNA, 1544 bp, Homo sapiens
tttgaggtggtcgtatatttttcagacgtgctcatagatctgtagtatattcccggtgggtaatagtttatagttttgcgacttttttaaggaaccagtcattgtaagtctgtatttttgtgtaaagtatgaaacttcctttgaaaaggggtttatttttattttttctcttataggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcggtctgcttgtatctgtgagcatattcatttgtattttagggtctctctgcttgctgcttaggagagcaaatcagatactgtcattaaacttacaactaaaattactagctgtcacttatatgatattgctgggttcttactgaataattttttttt

SEQ ID NO: 9000 - DNA, 1287 bp, Homo sapiens
tttaccaattgatagataagcctaatatcacaaagagttacttcagaagacacaggaggtcatcaagatggagattttttttttttttttttaaagacagagtcctgctctgtcacccaggctggagtgcagtggcatgatcttggttcactgcaacctccgcctcccgggctcatgccaatctcctgcctcagcttcctgagtagctgggactacaggtgcccgccactgtgcctggctaattttttgtatgtttagtagaaatggggtttcaccatgttagccacgatggtcttgatctcctgaccttgtgatccacccacctcggcctcccaaagtgctgggattacaggtgtgagccatcgcgcccagcaagatggagatttttttaatgtttttttttcttttctttttccctcctggactcaagtgatccccccgcctcagcccccaaaatttctgggattacaggcaggagccaccgtgcctggcctcttaaatattaatagttagagtgaccccttagtgctaccttgaattgtatatcagcaatgcagaaccttctgccgtcatgatgatgttctataaagcactgtccaatatggcaaccacaagaatcctcgcccactgaactcttgaaatgtagctagtgccactgaggcactggattttaaattttatttaacttgaatttaaacggtcacacgtggctagtggctaccatactggacagctcagcttgcagtaggaagtaccaactcactaatgagctacaggctttccaattaatattctctaatttaaacattgttagcactgtttaacaagtttaatttgctgggcacggtggctcacacctgtaatcccagcactttgggaggccgagactggcggatcacgaggtcaggagatcgagaccattctggttaacacggcgaaaccccgtctctactaaaaatacaaaaaactagccaggtgtggtggcaggcgcctgtagtcccagctactcgggaggctaaggcaggagaatggtgtgaacccgggaggcagagcttgcagtgagccgagatcgcgccactgcattccatccagcctgggcgacagagcgagactctgtctcaaaaaaaaaaaaaaaagtttaattcaattaaacttactcaatatttaaattattatattgcctttggctgtatgtaataggcagctgaataaccagggctgtacgggtgaggggtttgtattcctcccctggcaagaagcttagtggcagttagtggagggctgagc

SEQ ID NO: 9001 - DNA, 1164 bp, Homo sapiens
aggtgcggtggagaaggatgaaggaaaggaccctgacctgactccagcacctggtggcaggagccgtgccatgagtaggggcaggagccaatttgggacagaaagttatttatttatgtggaggtgccagttagatgggaggatataaaattctggagaccaggaagaggtgagggctggaggtgtaggtttggaagctttagggcatattggtttttattgatatttaaaaccatgagtatttaaactcacattacctagggatattctgtgagcccacaagagaagaagcccagcagagagtcctggaggcattttagcaggaagtggaaggaccagagaaagatccagaggagctgtctgtgaggcaggagataaactagggaaggatgaggtcatggaagtaaaaaatgtatctggaaggctgagcgcttccttgatgggggccacagagttttccaatgacactgctatgcatggtttgtggacaggtgagggtggaaggctgattgggtgggtgggtgaagtcagggacagtaaaacctggacactgtcccagagggctgggaaggggcagagcccaagtgggagactgtggggaagcagattgcaggagttttttacaggcaagagatgtggggcgtgtttgtatgctggccctggtccgagtggcctccaaggggcagggggaggcagagagagctggagaggttgacagtgctggagcaaaagagaaccacgtaggaatcaagtccttgagcacggtgggatcagagcccaagtcaaggggctagggttaaagatttttttttttttgtggtaaaatatatataacatgaaatttgcattttgactctttttaagtgtacacaatagtggcattaattacattcacaatatagtatgaccatattgtgctagttccaacatcttttcatcaccccaaacccaaatactctgtaaccagtaagcagctgccccctaccccctactcccaccaccttgaaggccggggttttttgttttttgtttttttgagacagggtcttgctctgttccccaagctggagcacagtggcacaatcatagctcactatagctcagactcctaggctcaagtgatccttccacgttggcctcccacagtgttgggattataggtgt

SEQ ID NO: 9002 - DNA, 2345 bp, Homo sapiens
attgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattattgcttatgttttacataatggcatatctctcatacaaatagaacaggttgctaatggagtgaatgtcttcccttggtctcttgatttctcagcctctccccaagcaatacaatatttttgcagcctggtttaacttaacaacttacaagcttatctaggaaacacagatatttatgaagactaagccttgcaggttatacttacagtagcataaatcttttgggttactgcatttatttgttaaaataagtaatatcctgatt

SEQ ID NO: 9003 - DNA, 1298 bp, Homo sapiens
agcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacatactattttttctagcaaagttattaaagaaaatgggggaagaggcagctgaggattgacctgggtacgcctcagcgagcctgagtgggcgggaggcacacgcgttctggggaggaaggtgtgtgtctgcatagaaaccaagccaaagtgcccgtttggcagaaggtctcaaaattattttcttcggcctttgtttaatagctgagagtgaattaaatttttggaaagcccctgtgaggaatggcggcaggaaccttcagagcttctaatggct

SEQ ID NO: 9004 - DNA, 2116 bp, Homo sapiens
atacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataagtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgttggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaattatatgaatgtttttaaacctttgttttaggtagaaggtaccattgtgtctttgaagtacatgataatttgtcaattctgctcaactggtacattgtaagaaaccatcttgagccttttataattaatgaaacaatatgcattatgatgactgtaattttagatttctaatttaataggaaatagaaaatttgattcttttattagcttgaaccaaatgaagttgtcatctttgtaggtcaaaaatggttgaatattagcaatttcatacagttcaactgaatatttcagagaagacgtaggtaggaagaaccaagaggaaaggagaaaaatgcaaaataaaataagaaattaaaggatagggagacacctagaaaaacaggatgagttattcagactattgaccataatcaatttttataaaagtcttgatctgttctaagtttggcttccaagtttggctttccagttattaagagcacaatgaggtttg

SEQ ID NO: 9005 - DNA, 1171 bp, Homo sapiens
tgaagggggctttctgaaggaggtagagtcaaggagagtggtctctgaagacacttcacattacatcttgataaaaggtatcaggcaccatcatttatatatttacattaaaaaatcaaagatatatcatgactctgaattctataaactagcacccctggataatattaatgaaattctatttatgtaataactgtatactgctattaatggattaactactatagtgccaaaccactttaaaattagctaatgaattaactcctagttgccgattaaatgaaaatgtatatacttatttatgagaaccagtgttctcttatccatcttactagaagcgtattgtcacactgtaaaactgaatggtgagaagtgttttaattcttcttaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgag

SEQ ID NO: 9006 - DNA, 1171 bp, Homo sapiens; identical to SEQ ID NO: 9005

SEQ ID NO: 9007 - DNA, 1527 bp, Homo sapiens
ctatgtgaccttcgtcagattttatgacacatgccattgtgtgtaagttgtcacctcataactaaaatattttgaaggcatgtaattcataggaagtccttgtttttacccccttttttgcatttgcattaaaaatttttttgtagatacataatagataacacctgttgcaggggtacatatgataatttttaatacatttctataattaatttttacttttaactttcaggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattccctttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttag

SEQ ID NO: 9008 - DNA, 1362 bp, Homo sapiens
atattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggtaagtgtaaagcatacatgaaaagtgttttgtattttgctttatttccttttttcggattttgtggattgatttttgtgccctataatttgacttattttggggggattctcaggactaactttaaaggctttttgaggcaaggataggaacaattgagatttttccttccaatctggacagaactccaaaatttgcagtgattttaaaaaacaagttttctggggaaattattttgttctctatccccagttttttctttcctaac

SEQ ID NO: 9009 - DNA, 1160 bp, Homo sapiens
ttaacaacttgtcctctgattataaagtcaataacagaataggttttctgtccggatttattgttcctaaattagaactaatgaattaggctctttgtatatacctgttctcctgtatttagaatatgataaaggaaaaaaagattttatactcatttgaatttctgtatcagttaacatcttggtatctgtcatttcctcaaatgtgacatggaaatgaattctgaaaaaatcactgaataatatcaggctcaatggcttgatagacttaaaactagttttgtttaaatttatagttttaaaagtaaatacctaacttgtttttttcactttgtttgctagtcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtg

SEQ ID NO: 9010 - DNA, 1241 bp, Homo sapiens
ataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaataatttcttatgttctattctttttaaaacaattcataatagttgtatcacatagatttttttggtgtcagtaaaatttttttttttttttttgagacagagcctccctctgttgcccaggctggagtgcagtggcacaatctcagctcactgcaacttccgcctcccgggttcacaccactctcctggctcagcctcccgaatagctgggactacaggtgcccgccaccatgtccggctaattttttttttttttttttttttttgagacggagtctcgctctgtcgcccaggctggagtgcagtggcgcgatctcggctcactgcaagctccgcctcccgggttcacgccattctcctgcctcagcctccggagtagctgggactacaggcgcccgccaccgtgcccggctaatt

SEQ ID NO: 9011 - DNA, 3384 bp, Homo sapiens
aatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttcttggttttaatgttccagttgctgtgaaatagaactcctacaatcaaaagacagttttaggaagtcttatttattgattttaaaagttttacatgtaggagtgtgggaatgaaggaattctggagctttttgacacaaaacctattaccacatttagcagttaaatggctataggtgggaagtaggatttagatgtatagaaaagtaagaaaatcttacttagaaaaaagccccttgaaacttgcaggatttacttaataaaaatacacgctatgagtcataattgtgccaagttgtttcatgcagtcctcaaaaattagatgtaattgagctttgtgtaatattatgtcagctttaacatataatattttgaatattttagctatatttagtggctttctgcaagcaactagaacagagaagtaatgggtcaataatcttgaccttaatttaaaactttcaatggagatagggctagaaatacttttgccaaatagcattcttattcactttatgccggtatttagaaaaaataaattatagcaagtatgatttctaagaatgtttttctataaattactaattgtaaaaagtcttgctttttaaaacaagttggtaatgcatatcatggaaggcatattttgtatgtataaattcaccacaattaaagattattcttgtcagtccttgctatgtagaatgactattctaaatattaatgtattaaaaagaaaatacaacaaaatgtatatttagacacgagcttacatggcataccttatatttgtatcattctttaaagtttacaaaaaaaaaccttatgtttttatgtaatcagtcattacactagggagaaatttatcagctttagttctaaatatgctcatgaggtataaaagctatttcttcatcagtattttgcttttatgctgctttttctttttgatactccaggtttataaactatcttttaaaattttaagccaggacttcaaaaattgtagagtacttgtttggcgttccctaccttcattctcttagggttaaggagcctttctttctgcagctaagggcagaggctgtgcctagggctataccaccactagcatctgtatttgagactgtttccttagatgggtaagaggtggaaaacaaacttagtatcaggggtccatgaagcccatggcatcatttttgaaaatatttctagttttgtagccaaagcaattggttttagtaaaatgagacttcttcaggagtcactcctttactgtggacccattgcttagtgggaatggaagtatatgtatctatcttgtgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaaaaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaaaatggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatatttcattttttataaattatctttcaagctcagatagcttaagagcagtttatattaaggagacccttttctccttgaggatagggataggtaaggtaaacttgtaaaaaggatgtcacagaagtcactttttaattaagtcatgattgagatactgaactcttccactcattcttctttcccattttcctattatgtttgataattatatgtatttttaaaaactgtgagaggaaaaattagtcataacccttttgggttatccacttaaatttaggtattttcatattactcaggtaaagatggaaatgacagagcacagacatttattttttaaattg

SEQ ID NO: 9012 - DNA, 1286 bp, Homo sapiens
gcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaatacagtcctgaagattttttctgtacgaattctctgtttaacataaagccaatctacttttagagtttgggagtaagtgaggaaatactaggctcctaaaaatacttggatacc

SEQ ID NO: 9013 - DNA, 1888 bp, Homo sapiens
tgatctagtggaggagaatggaaaaaaagtgaaattgtagtacgaggaggcagggtggcacagaggggaatggccaaggcttcggagccagactgatgtggcgggacttcagctgtgccctatggggctgtgggcactggggcaggtgccagggcctgggtgtgcagctggtaacctgcagtgttctgtgtgcgtgggaccgtgtgtgcactgcacccagcacctgcctgctcactgggtggtaccaggttgaggcctgatgccaggggctgggctgatcccttagagatttccgagcagggcaggagtgccatgtttctgacgtgctgtgagatgatggccaatggtctgtctctgtgtcgtgttttaggaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttagattatttttattttgcacttcttccaaatgagagt

SEQ ID NO: 9014 - DNA, 1302 bp, Homo sapiens
tccccacacaaacaggtgagcagtggctcacaggtgaatcttaatctagcttttcaccctcagccagcctctgccagcctgcctggagcctccctattatcacacagttacacctaagggaccctggacaaggctggcttctggtgttcactgattgaaaccttatcatgcaagtaaaacttaccagatgacagaaccctttccaatgttaagcaaattgtattttaccacagccttttcactctcttctgagttacgtgtcaatgactaaacaggactatcacttggggactccctctgtaagttgttttgtgatagcgggtctgctggaaccttcccctttcctgtcaccagctgcatgtccacgtggaggtgcaagtggcatggccaggcccactctgccactgccgcccagcagggtcttccagatagtccagggcagaagggcaggacacgcaggcttctgacccaaaacctcctggcaagagttggccttgggttccagcaatgactccatgttccttttgtatgggtgattttttttttctttcagctaacaattttctactagagaactctcatctgagagtttcacgttttttatgttcttcttataattctttacctaatatagtatctgatgcatcagttactactataaaaaaaaaaaactccaaaaagtggaaagtcccaaacccttcagagaaaacagtaccttgaaagcttttacatttctttccagtgatctttttgtcttgagtgaggtaatgaggcagctggagtttatggtgtaaaagtaaacatatataaaatcctctcacgccctgaaaacacgatcctaggtatttgccaatttttcaatggctccaatgtttatctgcaatggggctcataaatcccatgatttgaatatgtgatttctagaaatccaactccatactaagccagaaagtttagcaccaaagctcaagactagatgggctggcgcattcatgccttttactacacgtgagggaggcatgaacaggcgcttggcagaggtcctcagttgacccaataattcattggccagttgtctgggaagggcaggcgggcctcctgggtctatagggtaaagcatcaactcatatcctccatctgctgtttcccaagctatttttaattttgattttaaagccacttgccaaatccctccatataaatcaaaggttgaaatgatttgaatggtttcaaattgatctaacagactccttattctaggtttacgatattcactgtatttagttgtagtgagttattcat

SEQ ID NO: 9015 - DNA, 1107 bp, Homo sapiens
atggatgattaggcagatgttttgttttgttactgaaatgcagtggattatatctaccgctcgtatctgctgtcacggctctagttcttaccgaacggccagcctggctgtgaattagtgtccatgcagctgcctctgcagcacgtcctggtgcctggggctgcctcctgcagggggcccatgtgtatttcaccagccccctcttgctgaaggcgcattcgcgaggatgcctcatgtccgtattgacactcatggtttgctgttcagtaaaaacaaatgcacagaagagggctatgccctgaccccgtgccacctgcaggctgtgattcctaaccctgtcctgcccccctctctgtgcagcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgcca

SEQ ID NO: 9016 - DNA, 1165 bp, Homo sapiens
ggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtg

SEQ ID NO: 9017 - DNA, 1729 bp, Homo sapiens
ggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaacgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtggaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactcagtgtgtccctggggtttctctctgggcttgggggccggcggggtgtggatatctgtggaaggaatgggaagggaagagaagtttactattgtttcattttgcttataagattttacttgactcttctgacactcttcatacggtgttttttctatttttgagtttctactctagttttatgggcaccgttggtactgaacctctgtggaggaaggatgaattgcatgtcagttcagtattgtgcctggg

SEQ ID NO: 9018 - DNA, 1187 bp, Homo sapiens
ggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtctgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcagttgagctacctgatgctactgacacacacatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctca

SEQ ID NO: 9019 - DNA, 1165 bp, Homo sapiens
gcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacagggtcttcctgtgttgcctaggctggtctcaaacttctggcctcaagtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgattttttttttttgcaagttacttagcagaacatgtaattcacagtaaagatgattctgtgttgtaccacattttaatattcctgttttgaaagaatagtagagagaaaatgggtggcctgctcagtgattgcttttcgtagtcttggtgaatgttacaggagattgaatttatagataaaagcacagtcatcgtagtt

SEQ ID NO: 9020 - DNA, 1154 bp, Homo sapiens
gcgtcctctagcccaagcccaatgcccggctgctccagacgtcgacagccccatgccccgcctcctaatcggctgctgctggcgtcctctggtccaggctccgctccctacccggctgctccaggcatcctctaggctagaccccgccacctaccggccgctccaggcgtccgcagctccaagccccgccctccgcccggctgctccaggcggcctccggctcaagccccgccccctgcccggcggctccagaggtccgcggctccaggccccgacccctgcccggctgcacaaggcgtcctctgggccaggccccgcccccagcccggccgctccaggccccgccccgccccctctgtgcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaaggtgggtgcgaacgctttaaggcgccattttccccggctgtccagtgggagtcggggaaagcgggtctgaggtgcgggggacgtggggcgtgccgggatcgcggggcggaagcgggatcgacggcgcctgtgccccgaggggcctagggcgcctgtgcggcagcgctcgcggcccggagtcgcggcggggcagccggggggcgcggggcggaagcgaggtcggtggcgcctgcgtccggaggggcctagggcgcatgtgcggcggcgcgcgtagcaagtttctaacaaggcgggctccaagggtcccggcgcctgttggccggatcctgtgcgagcgcgcgcgcgcgcggatggtgcggggccctccaggccgggccggaggcgcgagcgatttcgcagagccgggtattaggccgcgaagtcgcccaggcggcttccggggagccgagct

SEQ ID NO: 9021 - DNA, 1165 bp, Homo sapiens
ccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcc

SEQ ID NO: 9022 - DNA, 1268 bp, Homo sapiens
cacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaatgtgtcgcttcgtcttctttgatgtgttttctgtgtgcttgttagctttacagtttctttgggctgttttagatttgaaaattctgtctgtctttgatactgaagataacatgtttcctttaaagtctagagtttgagaaaatttgaagatttttttttaaaagacaaggaaagaacactggaagtcttaggaacaaaagctgaagtaacaggtcacgctggtaggcacagcccccaggtcctcacccatgcctggaggaatgacctgcattctggaaggcgctcaggacaccgttttgtgggatcaagtaagcgaaactttcttgaagatatctgtggggtcccttttaggagctgtcataaga

SEQ ID NO: 9023 - DNA, 1218 bp, Homo sapiens
ggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgacgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcagatgcattcgttatttcttgagtagtttatgaagggacagtttacttgctggatttgggggttgagggttggtagaatttgatttaatatagtacagcatatgaattatttaatcagtgaaaccaggaaagtagactttgtgtgacttttggtatagaagcaaaggcaatgtcaccgctcaggtct

SEQ ID NO: 9024 - DNA, 2833 bp, Homo sapiens
gtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacg

SEQ ID NO: 9025 - DNA, 1350 bp, Homo sapiens
ctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcaca

SEQ ID NO: 9026 - DNA, 1136 bp, Homo sapiens
ccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcagg

SEQ ID NO: 9027 - DNA, 2196 bp, Homo sapiens
ttatacgtgcccttgctgatggcagatgtcgggtctgcctcgcttatacgtgcccttgctgatggcagatgtcgggtctgcctcgcttatacgtgcccttgctgatggcagatgtcgggtctgcctcacttatacgtgcccttgctgatggcagatgtcggatctgcctcgcttatacgtgcccttactgatggcagatgatgtatgtacatttcacaagtttcacgtttccctcaggaaaccacactctgaccataaactcacatggacgctttttttatcaagagataacgttaactttgtctttaaaatagaaagttttgttcatttcataaatatgtgtataattataaatgattttcatataaatatctatttgtatatatatttctataagtatagttacatacttcatgcatataccccttgtatgtaaatgtttgtaaatttaatgccattgtaattaggggggttttattcttcttttttagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgcaaatgacacattcttcataactctttagcagctttgactactagtgcactagacagaagtcagagcagggagcacctgtcccctctcaagtgattattctttcctggccacctctacca

SEQ ID NO: 9028 - DNA, 1187 bp, Homo sapiens
caaacctaggctcaagcaatcctcctgcctcagcctcctgagtagctgggacgacaggcagacaccaccatgtctgattagtttattttgtttttgtagagatggggtcttgctatgttgcccaggctggtcttgaactcctgggctcaagcaatccccccacctcagcctcccagagtgttagcattacaggtgtgagccaccatgcccagctgcaaatttttgattatatgaattattaagccaactttctcttacacctgaaatacttttcagtcttttactgacatgtaatactaacctttttttggtttatattaaaaatgagtacctcagtagtgatatcttagttggaaatgaagtataagtttatatcagacttacagaaaatctctttctttgaacttttaataacctgcatcccaattgggttacatttaattgtgtttattctagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaaggtaagaaccaaaatgggccgattatgaagtgatagaaaattgggttggaggattgtctaaagttacttttacctaagaagtacaggctgggtgtggtggctcacacctgtaatcctagcactttgggaggctaaggcagacagatcacttgaggtcaggagtttgagaccagcctggccaacattgcgaaacactgtctctactaaaaatactaaaattagccaggtgtggtggcgggcacctgtaatcccagctactcgggaggctgaggcaggagaatcgcttgaacccaggaggcagaggttgcagtgagccgagatggtgccactgcactccagcctaggcgaccaagtgagactgtctctaaaaaataaaaaacacacagccaggcgcggtggctcacgcctgtaatcccagcactttgggaggccgaggcgggcagatcatgaggtcaggagttcgagaccagcctgatcaacatggtgaaaccccctctctactaaaaatacaa

SEQ ID NO: 9029 - DNA, 1209 bp, Homo sapiens
gcggcacccccaccccctcagagagagcacccccaccctcaaaatcctactttggtaaatattaatgtttaaccagttagcaaaatatttaacccagttagcaaaattaacaccgtcatttcgatagttactctgttgtgcatagtaaatgctgcaagatgaacttcacattggatgaagcagatttgagaaacgtttgccagaaagtgtgcctccccttcgacaggaccctaagcccagagaaaggaacagaggcccctgcagctgctgtgcctgcgtgcaccaggctagatagtctggtagcctgcgtgactcctcttcctgccgacgaggtaggcgatgaggacgatgaggaccagccccgccagggcaccacccacagcgatggggatcagcatgctgttctcgtccagcagacactcctccactgccaagacagacggatggtgtcagggctctgctcacacaggggcctgcaaacaggcctctctccccaccactcccccacatcagccaaaaggcaaagaggaaccctggcggaaggttccagctctagctggaattgtcacttggggaagccgctgcagagactggtgctctctgcacggcgaggaaaccacacacgtctctcccccgtctggaatcaggggctgtggccggacagctgtgctgcgtccagggcctctgtgcacatcagatgacagtgttgtattcaacgttcatgggagaagcgccaccactgtttcttaaaatgattcccttactctcaaatggtaccaggggctcccagctgagagacacgctgggcctctctaaagcagggggagttacctctagaatctcagaccggcaagaagaaacagctccttgcagaggaacaggggcgtcgccccagcccacacggaagcgactaaacgtccacaggcggagtctgaagcacgtcctccacaccccgcgacagctgccctcggtgacactcaccagagccaaactggccaccttccaccttgaaagcctggacccacactttgaatatattgactgaaaacgccttcgtgacacggacgtgctcctccgcgttgcacttgtaggaattgccgactgtggcctgcagcgctcgcagggagccgttggcagctttaaaggcagggtctgcaacacacacagaggtctagtggctccagaataccctgggcgcgcgggcggggg

SEQ ID NO: 9030 - DNA, 2052 bp, Homo sapiens
aaggagctgtttcttcttgccggtctgagattctagaggtaactccccctgctttagagaggcccagcgtgtctctcagctgggagcccctggtaccatttgagagtaagggaatcattttaagaaacagtggtggcgcttctcccatgaacgttgaatacaacactgtcatctgatgtgcacagaggccctggacgcagcacagctgtccggccacagcccctgattccagacgggggagagacgtgtgtggtttcctcgccgtgcagagagcaccagtctctgcagcggcttccccaagtgacaattccagctagagctggaaccttccgccagggttcctctttgccttttggctgatgtgggggagtggtggggagagaggcctgtttgcaggcccctgtgtgagcagagccctgacaccatccgtctgtcttggcagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacaggagcagaaaaccagacaccacttgttctcacttgtaagtgggagcttctgatgagaacacatggacacaaggaggggaacatcacacactggggcccgttgggtcgggggcagggagag

SEQ ID NO: 9031 - DNA, 1172 bp, Homo sapiens
tgtgggaggggactgactgtctgaattgtctttttcgactgtaggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggtgtgcagccgaggcgcactgcctcggtcatggagaagtcgggctgggcaccgcccaccccgctttgtgtctggtgtagtgggtgctctctgaagggctggcagctcttggccaagacggggagaagctggcctcgtactcgccacaggacctcggagactttccctcgtctgtgctgggagcatgtgggatggatttcacccactgcccctgaattcagcctctactgcccctggggttacggcccccgcgggtggtcccgccagagctgctccttccactaaagcaagatctgatgagctgtgtctttccttaaaaacacacacacgcaaagctgcaaaagcctgcctgtgttggtgcccaaagcttcaccagctaggaacctcaggtggcctttcccgccatgtggggactgaccagagtgtacagagttgggctttccctcgacctgaagcacacttagtgctttgcacctgttgtcaagcggctgtcacagcccaagctgtatgaaattacagcctgctgaaattagtcctaagaattcccaaatttacactgaaacgtcccatagttcctgattctggctgccctctttagaaaagtggtgcttggggctcacgcctgtaatcctagaggccgaggccagcagatcacgagttcaagagattgagaccatcctggccaacgtggtgcaaccccgtctctattaaaaatacaaaaaaattagccagatgtggtggcacgtgcctgtaatcccagctactcgggaggctgaggcaggagaatcgcttgaacccaggaggtggaggttgcagtgagccgagatggcgccaccgcactccagc

SEQ ID NO: 9032 - DNA, 1919 bp, Homo sapiens
accacaagccctgaggcggggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttaggcccagacgcggtgggcccgggtggtccctgtgggtgcaaaccccaccaccacatgttgtctgaggcacatcctccgggagcccaccctgaaaaggtggaaggtggccaagggtggaggtcttggtggacacagggcaaagaggcaccttccttttcggtgcctgtggtgcagagaaagataagccaagttccttggccttttttcacaatgaaaattgagacaaaatttaaaagtttgactttgagaacaagaataagattgagaggattctgggaagatggtggaatagggagcaccaggaatctggctgcccaggtagatgtctacctcgcgggcaggatctgcctgatgcagctgttctgtaactacggaatctactgaaggcttaaagctttcaa

SEQ ID NO: 9033 - DNA, 1113 bp, Homo sapiens
atgcacctccggccgtgtgtgcgtcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaattacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatt

SEQ ID NO: 9034 - DNA, 1166 bp, Homo sapiens
tgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaagctttcaaaaatacctttttcctctgaaagactccttatactaaaagattgaattaccaagtaaatgtaaatggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttatta

SEQ ID NO: 9035 - DNA, 1104 bp, Homo sapiens
ccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagc

SEQ ID NO: 9036 - DNA, 1132 bp, Homo sapiens
ggactgacactgaagatgaacattctcaccatgtcatggacagtgtccgacaggctaagttggctgttcagatggatgtccatgatggccgctcctggtgtgagtgctctcaaaagatctccaacaggtttctagagcagatgttttcaatcagagcaacatttgcagtccctcttttgagtgtgattctgaggtttaagccagagagggcatctttgttttgaagacacacgaaagacattttggggaactacttttctaggaactcttcgatcttttgatcctagttttcacgtaagcaaggaagggcttttgtacagtctgttcaaacttcagtttggtgtccttggtgctctatcctagtggagttttgggtatactaagtatcgtgtcattcctggtttggatttcttgtgggacctttcaaatatactttcaagaatgatcaaaataagtcatatcttgaacttggactctgagatgatttgtcactgtgtttctctttcagatattcttgggaattcatatctttccctttacttctctactggccagaaccctaagatctcccagcaagccctcagtgcctatgcccaagcagtaagtacttatggtcaccaggccagatgaataggcaacaacagaagcaagagcattgttcagtcttctttgtggccctttagcaagcatcatgggcagtggcagtgtttgctggcatctcatttttgtgattttgcaaagatgtgtctgcagagatgactgacttcttataacttgagtgttaggaaccacttgcatcgtgtcgcattggtgctggatagctccttgacctgtctgggtttcttacacacatatataaccaaatcacagagctgcctcaacatgttcatcttttttaatgggaaaaaagtctattaaaataatacttattaatatttttgtacattcattttaaagaataatgaaaacttatacttcagtgtaaattaagtgctatccccaaattaaccgttaggtaatattatggctctggatttcccatgggctaaaagagaaaacaatgtgtagcttgttctgtgtcatttcctaggaattaagtgaattaggttatttaggttttcaagaaatttat

SEQ ID NO: 9037 - DNA, 1169 bp, Homo sapiens
gtactggcacattagttgttacagctccgcaaggctttatgcacaattatgtaatccccaaagctctgaaaaccgaaatttacaaaatttagcaccccaactggtttggtagccaagtgcaggttatagggagctggaaggggaagggggtcacagtaggtggcatcgttcctttctgactgcccgccccccgcatgccgtcccgcgatattgagctccgaacctctcgccctgccgccgccggtgctccgtcgccgccgcgccgccatggaattcgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactttttcccatagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaaaaaacaaaacgaaaccgggccgggcgcggtggttcacgcctataatcccagcactttgggaggccgaggcgggcggatcacaaggtcaggaggtcgagaccatccaggctaacacggtgaaacccccccccatctctactaaaaaaaaaaaatacaaaaaattagccattagccgggcgtggtggcgggcgcctataatcccagctacttgggaggctgaagcagaatggcgtgaacccgggaggcggagcttgcagtgagccgagatcgcgccactgcattccagcctgggcgacagagcgagtc

SEQ ID NO: 9038 - DNA, 1536 bp, Homo sapiens
aaactgagatacagtgtgggatgggatgagtatgttacgcctaagggaaggaagctgatcagctctgcctttaagaaggtccctgagggtggctacatgtggataaggaacaaggactgaagcgtgagttattactgttcttagaactaataggaggtagtggagaccaacattaaccccatctttcttttcttctccctccttatcttcatcagtttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctacgctttttcagttgttaacttgtgtgcatgaaaatatgaggaagagaatgtgtagccccacgaaggggtaagacacgaagacagcaaggctgaaactatggctctttattttcatgtggataattcaaacaaagtcattagtagtctttgttcaatttttttttaaaaaacaaaaaaccctcaaataaaaaatcttgggcttaaaagaactctatcacaggagcctggttggaggattcctagttttatacatgagaaatagaatgcagatttctctgaagagtgtttaaagaaggaatggtagttgagggggcttatttcccaggctcaaagtgatttaggggtggtgtcacagtgctaggtatagggtgataggacagtgatcactgccgagggccttggaacggatcttgctgtcacacaatgcaggtaacagagagtgggacaacaaaaagtaatcaaggcgccaaccaaca

SEQ ID NO: 9039 - DNA, 1179 bp, Homo sapiens
aaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttattattctttgtctaggtgtgcctgcatcatgctcctcttcctatcttctccctgtccacgtctcatattctcttctcaaagtgatataaaccctgggagagggcctttgtggcataggcacttcacaaaatatgaccacatagaaactggctcttttccaatacaacggtgttgccttgatattgtagtatttttaagcctgggagagaggaaccatttagatcttaggagacttccttatcaactatgggtaactgagaaaggccacaggatttcagagataccaccaacatcaccacctttaagaaagaattgaagaggctgggcaaggtggctcgcatctgtgatcccaacacacttgagaagctgaggtgggcagaccacttgagctcagaagtttgtgaccagcctggggaacatggtgaaaccccgtctctgcaaaaaatacaaaaattagctgggcttgatggtgcacacctgtagtcccagctac

SEQ ID NO: 9040 - DNA, 1243 bp, Homo sapiens
gtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctgcttccctctttgggtccttctgtcaggaaatagtcacctcttcagacacttagttatcacccaaagagtttgataagaaatgcagaatattgggttttacccccaggtttcgatgcagtagctctgatggggcccaagaattagcatttaacaaacagccaagcaagttctcacgcactgtggcctgaggacctcattttgagaactgc

SEQ ID NO: 9041 - DNA, 1176 bp, Homo sapiens
ctcctcccccaactctctcttcattccctctccctctggctccctcccccttcatgcccctccccctctgtctgtcttcagactctgctgctgggaggtgtttctctcccatgcatgaatgagtctctgtaatgaatggaaatgaatggatcaggaatccaggcggagggagggagaatgaggggggaaagacagaaagacagggtaagggcagaaggaagcactgtggaacctggaaggatgtttggctggctgctcagttagggatctcagagcaactggtcccacttggataaatggggagcatggcaagcccacctcatttgctcaccacactgcatagcccaacctacatgggagaggggcatattgtgatggtcttccccaccgccagggggtggggtggtagctgtggttgttctggaccatgcatttaaaatatagaatttggggaagaaatctggattatctgggaggcttgtaggcttggcaagtcaagaggtacagtttttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagcccaccttccctcgtgttgtccttctggccctcgaggcgacgcccttgcttcctttacagctctaccttcaccctttgctctacgcagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtg

SEQ ID NO: 9042 - DNA, 1797 bp, Homo sapiens
ttgctaactcatatcttcggtacatttgattttaatctagtattttgtttatattaaagtgaaaggagatgaccttcaggccattaagaaggagctgacccagataaaacaaaaagtggattctctcctggaaaacctggaaaaaattgaaaaggaacagagcaaacaagcaggtaaatgggttttctgcttgcccttggtatacagttgggttagttacataaggcacttgaaagtacatgttggaatagtggaatataaagcaatgtaatatgaaacttggggagtgtgaattgggaagggtatttgtgtgggaggatttagatttgtgctgcagttctgtgatccttagtggggattgtctacgtcctgtggacattactgcccctagacagacttgtccttctcatccgcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagat

SEQ ID NO: 9043 - DNA, 22210 bp, Homo sapiens
acttaatgggtaagtgtaagctatccatattaatctagctaatgaatggcttgggacagaatttgacgtttgctatgctgtgtgtatatatacagaaccggtgaaactcaataaaagcaacgtgaatcaagattattgatggcagggaatagttagcatgacctgtaatgtgaaaaacagcagaaactggtgtcagagaatttaggcaaatctaatttgcttgagtacttagaggagggccacttggaattatgtccaaggaaattatattgccaatgatctgccagggagaatttttttttcctgagaatttagagtttagtgctgctgaaatagaatggaagaggaagaagttgactttctagagtatattcagaggctggagtctctgaaattattagcaaatacatacttaatgctgtgagtccctttaagttgcctaatactctgggcagttaacagtgattcagagtgagagtggagaatgttttatcaaggaatattgtttttagcatctgttcacctgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttaggtaagtgaattttttcattgatgatgtaattcaggcctgagtttttctattcacgttttttttttgtctttatgtctgtaaaactgacagcatgagatattctggatattgcgactgtttagcctaataaaaatacattaggcttatagttataattggctaagtaaaggatattcttcattgtaccattttgtgtagtagagctaggacaactctactacaatcgtgagtagggggagctgggaatgacacttcacaatgtaaaaacgttgcctaaatggttgtgtcctgcccacagcagactggaggagccctctagtgttgattgcttgtctccccattgggatttcactccatccgttgggccgactgcagtttggctcagtgttagattttcttgtattttaaaatgtaatgacacctcagagtacttactacctatgatttggtttattcaagccagaatccagtgtccacatgtttattttattagttgtactagatgtctgttttaacttctcattttatgtgtaccttgtgcctcagtttcaaaattatcatacctttgtttttacaaagttaagatgattatttttaaatttatatttgtgatttagtttattctttgtatacattctactatgtatattgactcaaagcatggtaggttagagttatgtgaaacaattctttgataatgttatgtaaccaaccagatacataatttgggtctatttcattgtttttacatcttactggattgctttttcagaaatttaattctctttagttttgaaacactttatatggtttcaaagtcagaattgtaaatgaggttaatgtaccaaaacctgaaggttattcatgtaatggtgttcagcaaatagacaatatattcagtcctttttttttttttgagacagagtctagctctgttgtccaggattgtgtgcagtagtgcagtcttggctaattgtaacctcagcctcccgggttcaagcgattgtcctgtttcagcctcccgagtagctggtactacaggcatgtgccaccacacctggctaatttttgtattttttagtagaggtgaggtttcaccatggtggccaggctggtcttcaactcttgacctcaggtgatcctcccgctttggcctcccaaagtgctgggattacaggcgtcagccattggacctggcctgagtcagttttcagttggtcatttgatgagctgcttttgtataaaaagggaagataaataagattaagtttaagatatccacatttggccaggttcggtggctcatgcctgtaattccagcactttgggaggcttgagttgggcaggccatgaggtcaggagatggagaccatcctggctaacaccgtgaaaagccatctctattaaaaaataaaattagcaggctgtggttctgggtaccggtaatcccagccgctcaggaggctgaggcaggagaattgcttgaacccgggaggtggaggttacagtgagccgtgattgcactccagcctgggcaatggggcaagactctgtctaaaaaaatacccacactcatctagttaatggtttgaggtggaatttggaatttatattttggggcatttgtatattaaaatgaagctcattttaataaaagcagtatatatgaaaatggagttactgttgactcgagtgctgtagcatgactgggaaggtaaactgaattttagagagtttttggctttttgacatgggctttttagaacaaggagaagataaattcttgtttggtaggcagtgggtggcagggtaggtagctgggcatacgtgttacaaattgtatttgaaaaccagggttgtttccctttgctcttttattttttttggtgtgtgtaaaggttgtttaagcaattgatcaattattcagaaagcagtcgttaacccaggatattttacgtgtagaacagctaatccttacttataaagaaaatctgaagttgcctttgaggatgatttgaggttgtcacacttcactatgttaatttgtgaattggcatatattttaatatatttcattctaatatatttgtaataattcggaatgagctgaaccattcttggaaaggcaaccagtgatagttttctcttgtaatagtaactgagtgaacagtcagtaccttgaatggggagagttgagttgaagtggtatctgagggtggagagtaccaaagacagacttaatgttagtctcaggaacacttgaatggtaaagaacagactacaaagaaacggaagatgaagccttagccttgtaaaaatttgtgagcctttttaatattaaaaggagagatgaagctgagcttgatagctcacacctgtgattccagcactttgggaggtcaaggcagatcacgtgaccccaagagttcgtccctacgaaaaatagaaaaattaaccaggcgtggtggtccctgctacttgggtgggaggatcacctgagcttcggaggtctaggctgtattgagccattattgcatcactgcactccagcttgtatgacagtgagacagtgtcttaaggaaagatgagttgttttgttccacattttctaatttatgtgtctgtgtgattttctaaacttcgtagtttgtattagctgggcatggtggtgcccgcctgtagtgacagttactctcgaggctgaggcaggagaatcgcttgaaccgggaggtagaggtttcagtgagccaaggtgacaccactgcactccagcctgagcgagaaagcgaaactatgtctcaaaaataaaaaaaataaactttgtagtttgttttacccggatacaaagttgtcattaacatttttacttttgtttttcagatattaacctggctgcagagccaaaagtgaaccgaggaaaagcaggtgtgaaacgatctgcagcggagatgtacgggtcagtaacagaacacccttctccgtcccctctactcaggtccggaactttattatttataactgcattgtgtccatcagtgggcatcttctctttctgttttctgggtgtggggaggtttaagtgtactgtgttttatctgtgtataaataaggttttattatttttgtgttaatatgtctcttttttgccctagagaaaatttctagagaattaaaaatccctgaggtttttgctattgatattaaagagtagtttgatatttatagcataacctgaaatacttatacaggatcgttgagcttctaagacactagagagtaagagagggtagaagtgtggtataagaatgcttagtttaccattctgtttttcagtgtttagtttagctatgtcgtatgtggaaatcttagcgaattttaacctgaatttccaatttgaccgctacatttccagtggtctaaggtgattggaattgagtgatttattgtatgaatgattggggatcattcagtgctaatcttgttgatctatttgttgtggtttatttggcatggttctcccctcacctgacattgtgaattagtagaaacatttccaaattaacccttttcggtatttatttttcagctcctcttttgacttggactatgactttcaacgggactattatgataggtatgttaaaatgttttgtatttctgctaaacagctatttagtgagaaccatttcgttcttctggtttgtggtgatgaacatcaaagatgttttcaaacatactcccctaactccaaaacaaaaaaacacctttttctaaatcattaagtagattattaggtagggtgatactgattttaatgcattatttcataatccctggctaacgtggtgaaacccgtttctactaaaaatacaaaaaaattcgctgagtgtggtgactagggactgggttatgggtggctttgggtaacagatttagaactgttgatagcaaatgcttaacaggaaataggatgatgtgcttaagagtgttaccacattgacattctgataacatcagtctcagttaacatgaaggaaatgttaagacttatttggcttgtcgcgttcaaactcatgcagtatatgtaagtatatggagcaaactattgtatgcaatagactttaaacatgcaatatataaagcatattactttatatactatttgtcttataatgccagtattccagtcattagtattttaatgttattactgtatataacaattcagtctgattttggaataaaaattactgattggggaatgcttaacatttgaactgagttaatcagtcatgcatgggagttgtaaaggaatcaagtcagccgttaaataccataaagtatacactgaaagtgtcagacatgaaagtatagactttctgtttgagaaataacctcacagaatatggtacgtagtcattagaaggccagaagagtaaggcccgaaaaggaattcaaatccagattgtaaagggccttgaatgccataataaaatggtgtggttgagcatcattaatgcatcatcaaaatgtttttttcatttgacattagcggtttcctcagatttttttttttttttttttgagacagtctcgctctgtcgcccatcctggagtgcagtggcgcaatcttggctcactgcaagctgcgcctcctggcacagcctcctgagtagctgggactacaggcgcccgccaccacacccggctaattttttgtatttttagtagagacggggcttcatcgtgttagccaggatgatctcgatctcctgacctcatgatccgtccgtcttggcctcccaaagtgctgggattacaggcgtgagccaccacgcctggcctgattttttttttttttttttttaaatacggaattttcctctcgtcaccaggctggagtgaagtggcgtgattttggctcactgcaacatacgcctctttggttgaagcaattctcctgcctcagcctcccaagtagctggggttacaggcatgcaccaccactcccggctaatttttgtatttttagtagaggctgggtttcaccatgttggccaggctggtctcgaactcctgaactgaggtgatctactcgccttgacctcccaaagtgctgggattacaggtgtgagccactgtgtccagccctttcctcagatttttacagttatgtgtgaacattttgaaaactaaggagttctgtaattcttcatttttatttttgttgaaatttttgaaattcttaaaaaataaaaatcagctgggcacggtggctcacacctgtaatctcagcactttgtgaggccaaggcaggtggatcatgaggtcaggagttcaagaccagcctgggcaatatggtggaaccccgtctctactaaaaaaatacaaaaattagctgggcgtggtggcacgcgcctgtagtcccagctactcaggaggatgatgtaggagaattgcttgatcccgggaggtggaggtttcagtgagttgagatcgcgccactgcactccagcctgggtgacagagtgagactccttctcaaaaaataaaacaaaataaaaatcaatggagaacttccagttgaaaataaatcaggacattactagtgaactcagcccatttattcctgaaattgcaattttttgaatttttgcaatcagaccttggtaatgacctaatgcagtaggatataaataactccgacaagcttagcattccagtaatggaacattaggcatagatgggttaattattggtcaggtgtcttgaaggcactgaaacccagtgagtttgtctgaagcatctgccctttaaccctttctgcacatggtaattgcttgaccacatttaaaatatactcatgccagcttctcctatagggattcttacacaactggtcttatgcagactttcttaagtactagtatatttttcagtgctttctatgtgttcttttgtccagtcagagttgagaatcattaataaaagattaaggacgtggttgtgtttctgtgtattattatcctatttctttgtcatggctcaattcagaccagtttaataaactcacacttttgttggtataatttcagggatgtcatggactcttagttgatgttttttatgagtgtatcaagttttagcagtatacagtgacagtcttcttgaaaatagttctcattaaaaagtcttttcttggcaaggcacattgtgaatggggaaatttgaaaatttgagcagggaatttggaaaacattagttgagacaatgagatatatactgcagagaaatctaaagaaatcacgtttgcagaaatatcttcacagaaattggtggcctcttcagattttcaatagacaacaatatattaggtttgagcaaaagtaattccgtttttgacatttctttgaacggtaaaaagcaaaaccgcaattatttttgcaccagccgatactagtagttactgtcggatatattgctgcatgttattgtcagtgaaaagtaatgtcttctattgttctaacgtcagccagtagataatgattactgataactagtggagcaactaggtaatagctggcaaagagctgacttttagagtactgagatctttgttgggaaaatgaattttaggaggtgtccacatgatgggaacttactcaagttgggttggagaattgaggaattgagtgtgtgtcttacatgatagatgttaatgaaggtgaaaggaggaggagtgtttgtttagtggggagaggggcagatacaggagttttttgctggtttggaaaatgttaggtcaatttggacctgggaaataggttgggtatgacctggtggaataacaacttagaaaaatggtattaatatcttctaagaagtcattctgaagattcattatcataaggtttagatttttattttaaatggtaacagcgatacttcattgactatgttaaattgtttaatcaaagaagatgggaaattggctctgagtgaaagctctgggtcttcatatgtaaatcggagtaaaaatcactgtcccccccccccctttttttttttttttttgagatggagtcttttctggcactcaggctggagtgcagtgggttggtcttggcttactgcaacctctgcctcctgggttcaggcgactctcctgcttcagtctcccaggtagctgggattacaggtgtgcaccaccacacacaactaatttttgtattttcagtagagacagtgtttgtccacgttggccaggccggttttgacctcttgacctcaggtggtccacccgcctgggctcaagggatctccctgccttggccacgcaaagtgctgagatgacatgtgtgaaccactacgcctggccctctttttaatattcatttgaaggcgctggttttgttttgcgaaaggtgttgtaataaaagtgaatttttatcacaatgttgggaatgcacaagtattcaaagctgtagttgttgaattaagcgagattgggaagtactctaaaaatagatctttaagtccttaggtaggctggcatatacatgaaattgatgttcgtcaacagctaccctggtactattctttctttcttttttttttttttttttcttttggaaacgagtctcgtgctgtctcccgggctggagtgcagtggtgcagatctcggttcactgcaacctccgcctcccaggttctcgagattctcctgcctcagcctcctgagtagctaggattacaggtgcacaccaccacacccagctgattttttgtatttttagtagacatggggtttcagtatgttggccagactggtctcaaactcctcacctgacttcatgatccatccaccttggcctcccaaagtgctgggattacaggtatgagccactgcacctggcccaacctggcactattcttataattctttaaaaaattctcataaaagtcttgatctatatgtgttttctgatttgtgccacaaatactgcagtgttttcatactaaaactatatctagatataaactagatatattttcttcagattgtaataaattggaaccccactttcccttataattgatcacccatgaaattgttctcaaattagataatggtgatattgcagaactaataaaaaccacggagtggcacccttttaaatggtgaattttatggtatgtgaatgacgttttgattgaaaatggatgcgacattacaattgaaaaaggatacatcactgtcttatggacagtcattcttttttgtcatatctcgtggaccctacctacatcaggatacttgccagttagagacatagatgaaacccgtctggtgctaccagcctcaaaaggtaactcttacgcctgaggatggacaccttttagaattaaaagaactctcagtcattgtgggacatcttgctagccttcatagagactgatttactgtcagctcttttcttgagtcgtctcatctctctctgtttttttttttcctttttttgagacagagtcttgctctattgcccaggctggagtgcagtggctcgatctcggctcactgcaacctccacctcccaggttcaagtaattcttgtgcatcatcggcctcccaattagctggggttacaggtgcctgccaccatgcgtggctaatttttttttttttgtattgttagtagagacggggtttcaccatgttggccagactggtctcaaactcctgacctcaggtgatctgcccacctcgccctcccaaagtgctgggattacagatgtgagccatcgttcctggcctctttaattcttatttggagaactttgggcaacacgaaatagaaactgccaataaatggcaggtttgataacaggctttattatgacagcggagacttggtgagcaagaaacctggttcaaaaagactggtttagttcaatggtctttctgaggactttttaaacttagcacattttgtatgtggtgcatgactagtaatacagtatataagtaacgagtatgaaattcttagaggttttcagagtgctgttattactccatggctaaatatattaatatgtcagtgcattagaaatagacaaatcttcaagaactcacaggtcaaagatgacacatgtaacaaagattgagttgtgaggggccttgatgtgtttgaggagcagccagctgtaaagtaaattgtaaagaatgttagttgtaaagggctttgtattacatgttctgggattgtgtcctatagatggtattttagaaacaggcctgtggctagaggaaaaaagatgtgttaaatggtaaacattgtaaatgttggaatggagaggaggttgggagaatttctgaagtagattggtcttgatgtgattggttggactaaaggtatgaaagtaggtgcttgtaggaaaataatagtcaaaagctgagattttgtcttcgtgactagatgatagattatgccattaatggttacatgaaggggggtttcacagagtttgtgctgtcagaatttcaaggagacaagcaattttgctgctggttttattctacctgacttttctaggaatgtatcttggtagagagagaaaattagttgaaatgaaaccattgaaattcaagacagaactgtcaaaccatcatttcttcaactattaatagttaatatccctaattttgttctgggcacacaaagcctgaggctttggattaacaatatgggttgaaggagaaccttcaccttactgagtttagattagcagacactttgacctccttttctatttttcagatgtttttgagtaacactgtacctgagagatgggtttgtttatatatatgtatgaagggagagagtgccaaaatacttaggttatttgaagtttgaaaactggggacattctgcattgaaaggcatgtgtttcacagagcaggagacttctaggctactttgaaaagctaacagatgactctcagaggtgtcattttaggtggagagggtactctgggcttggaagttttggatttgctcacagctccactgttaattatatctttcttttgggaacctgtgtatcatacatataggtgccagaaggattttagatggtgacatagattagtatacacttttggaacaaatcagttattagtcttttttgtttgttttttgttttttgagacctgatgtggctctcttgcccaggctcgagtgcagtggcgcatcactgctcacggcaacctctgtctcctgggttcaagcaattctcctgcctcagcctcctgagtagctgggactacaggcacatgccaccatgtctggctaatttttgtgtttttagtagagattaggttttgtcatgttgcccaggctcatcttgaactcctgagctcaagtgatgtgtccaccttggcctccaaaagtgctgggattataggcatgagctatagcatctggctggacttaaattttgctaaatatttatttcttagtattccttttagattagtttcttattgtgtcctagactcgtttagtaggtgggagatatttctttgtaggagaggcatttgggtctgaatcaatctgctgtatgactgagttgagcggtcttgattccatttttacccaacactaaggtatcctggtgttttatgaatcttcttgagggcattcttcaggtagattttgttagcctccttggtgttgcttttctttttgagatggagtctcaccctgtttcccaggctggattgcaatggcgagatcttggctcagtgcaacctctgcctcctggtttcaagtgattcttctggctcagcttccggagtagctgggattacaggcatgcatcaccacgccgggctctttttttgtgtgtgtatctttagtagagatggggcttcaccgtgttgggcaggctagtctcgaacacctgacctcgagatctggccgcctcagcctcccaaagtgctaggattacaggcgtgagccatcacgcccagctggtgtttttgttttggtttttttttgagacggagtctccctctgtcgcccaggctggagtgcagtggcgtgatctcggctcactgcaagctctgcctccctggttcacgccattctcctgcctcagcctccccagtagctgggactacaggcgcctgccacaaggcccggctaatttttttgttatttttagtagagacgcagtttcaccgtatttgccaggatggtcttgatctcctgacctcatgatctgcctgcctcggcctcccaaagtgctgggattacaggcgggagccactaggcccggccatagcagcatttttaaagatgtaccagaaaaactcaaatgtccatcaactgactaaagaataaacaaaatgtagtaaccataaaatgaaagaagtactgatacatggtacaacacggatgaaccatgaaaatattctaagcagacaaagccagtcacaagacacacattgtacgattccatttatatgaatgcctaaaataggcaaatccgtacaggaaaaaaaaacaaaaacaaattctgccatggagattggtatgcaaatttttgtgtggtcatgtgttttcatttcttttgagtatatatacctaggagaagtgctgggttgtatggtgattatatggtcaacctgaccaacagctaaaagtggctgtacccttttatattcccatcagtcatgtggaaggttccagttgctccacttacattcatatctgtcttttgcttttatccattctagtctagtgagagtgtggtggtatctcagtcaggatttaattgcattttgtttaaaaatattgaatgtcttttcatgtgtttttcagcttttttttttttttttttttttttttgagacggagtcttgctctgtcactcaatctggagtgcagtggtgtgatctcaagagccccgtctcctgagttcacaccattctcctgcctcagcctaccgagtagctgagactacaggtgcccgccaccacgcccggctaatatttttgtattttttagtagagacgtggtttcaccatgtttgccaggatggtcttgatctcctgacctcgtgatctgcctgcctcggcctcaaagtgctgagattacaggcatgagccaccgtgcccagcccagccatttgtttactcttccacacatgtattcagattattacccatttttgtattaggttgtagaattagttgtaggattcgttatatattctggaaacaagactctgagtacaacatctgatactgttagaaaattttaactgtttcttataattccaccatcctgctctgtagttataggagatatgtaactatccatttgtgctaagtcgttttgtagagtttttaaggattatgggttttgtaatagacagtaaattatagattactggactctggtaattacatataagcggtagatggaagtttgtggaggcaacaaactagaacattgcttgctgttcagtagaacatttaagttcagtggccacatgtgactagtgactatagaattggatagtgcaggtctagaatgctgcaaaaatcagttttactgggtagaataagtctagagttgtgtaagttataagaaatgtaatgactaaagcctactcttcaggaaggaaataacccagactgcagttgtagagcgaatgttgaaagagtaaataggagaaagtcatctgtagaaataaactggtatttgtgatgtccttacagcaggcatatgatttcacctccaaattcacgttcatcacaggcacaatagctgtgttttttgcatgttttttgtttttttgagacaggatcttgctctattgctgaggcaggagtgcagtggcacgatctcagctcactgcaccttttgcctcccggtttcaagggatcctcctgccttagcctcttgtgagttcctgggaataccggcgcgccaccatacctgactttttttgtgtattttagtagagacggggtttcaccatgttgcccaggctggtgtcaaactgctggtattagccactgggcctggccaatagctgatttttttttttttaaataaataccttgaaaacagatagaattttttggtaaagtatgatattcaacttttattcgattttcattgggaagtcccctgctttgatctttattaagccagaaaatcaaaacaccaatcctggcttttcagctattacatagatagggttcggtttgttacacgttgttgattgtgtgatttatggattattatttcctagaagtcagttgggaacttcatttatttactcaacaaatatttgttatgatcctgctgtgaggcattgtatatagcaggaatactataataagaaatagaggccgagagtggtggctgacgcctgtaatcccagcactttgggaggccgaggcgagcggatcacctggggtcaggagttcaagaccagcctggctaacatggtgaaatcccatttctaccaaaaatacaaaaaattagctgggcgtggtggtgggcgcctgtagtacaaggctgaggcaggagaatcacttgaatgcaggaggtggaggttacagtgagctgagattgtgcccattgcactgcagcttggacaacaagagcaaaactctgtctccaaaaaaaaaaaaaaaccagaaatagatggcctcagagaaaaggggttgggttaaagacatcacgtgacgcataaggcataatgtctttagcttttactttgaatgagatgggaagctattagagggctttgtgaagagaatgggagggtcttactcatattttaacaagatcactcttactgagaaagataatgggtggctgttcagagaagcagtgatttttggtgggaccagagaaatggcaatgggagtgatgaaaagcagatggatcttaaaggtgttgctgagaaatttgcttatgttgtgaggcttgagagaggaatcagatgtggccagcgtttttgtctggacaactggaattatggaatttacagtgacagtgattgggaggagctaaggtgaggagcagatatcataaatcagttgtggacatgttaaagttgatccgtttggagagatattaagtaagcagttgtttatatggttctaagggagtcatctgcttagagtttataaaaccgcaatactggatgattggaaacagaagagagattctgggggtactgtgacctttaaagaatgtggcggtaaggaagaaatgagcaaaggagattgaaaatgccaaaatgaaaaaaatggagaagcatgaagtatcttggaaactgtatgaatatatgtcaaaagagtagaaaggcaaacaaggtctttcatgtcactaatagttgaagtagtatgagaatttagaaaacgtctttttgaattagcggtgtcattggtgacctttgacaaaggtaggtactgttaaaggcagaaatcttacacagatttcaagtgaatggaaagatagaaattggagtcagcatagaaaacacacaataaaattcacccttttggtgtataattcctacatcagatttgatttacaaaatgcatagtcatataaccataactataaccaagatagaaatagttcccagttctctgaaatgcaccttcactctgttgcctagcaatcatatctgttccttaaaaggaattttattgtaagtgaaagaacttcttactcttctatgttgataaaatgagaattttaaaaatatgtaattttttttcccctttctttttcttcttttttttttttttttgagaaagagtctcgctctgttcccagtctggagtgcagtggtgcggtcttggcttactgcaacctctgcttcctgggttcaagcgattctcctgccttagcctcccaagtagctgggactacaagcatgtgccaccatgcccagctaatatttgtatttttagtagagatggggtttcatcatattagccaggctattcttgaactcctgatctcatgatctgccctcctcggcctcccatagtgctgggattacaggcatgagccactgctcccagcaatttttttttctttgtctcacaggctggtcttgaactcttgggctcaagcgatctgcctgccttggccttccaaagtgctgggattacacatgagagccactgcatgtgactcaatttcagtttttttttttttttttttttttttttgagagagagtttcgctttgtctcccaggctggaatgcagtggtgcgatcttggcttactgtaacctctgcttcccaggttcaagcagtgcctcagcctcctgagtagctgggactacaggtgcatgccaccacaccctgctgatttttttgtattttagtagaaaccgggtttcaccatgttggccaggctagtctcttaactcatgatctcaggcaatccacctgcctcggcctccggaagtgctgggattacaggcatgggctaccatgcccagcctcaattttagttttttaaaaaataaaattgcaccacattgtcagtttaaaattttatctttggtaaagatcaacactgacatatgggagtatgtgtattgttgaataccatgacaaatgagtaatgttaaagttatttgtggctgcacacggtggctcatgcctgtaattgcagcactttgggagggtgaggctggtggatcacttgaggtccaggagctcatgaccagcctggctaacatggtgaaatcccatctctactaaaattacaaaaactagcttggcttggtatcgtgtacctgtaatccacgctacttgggagactgaggcatataaacaagaaaagccagggattttttttttccctttcttaaaacagtcttgaatccagtcaagtttcagaattgatgattgatctaggactcaagcaacctgcctgttacagactagattctttttgactgagaaagttttcaggtgcattttcaaattgtcttcccatgaaatgtctggttttgtgttaagatagtttcctaatgaaaccatcaagacacaccactttttcccttaatatgcaacatttcattaagatgtcaaattttattcctcttaaaataagtatgtacatttaatgtattttttcttcgtggagccattttcaatcaaatggcttagaatttacaaaaatatccctaaatactaatatttgtaattctttctgatagaatattacagaaccaattattgattgatgccattggctcagtataggagctattgctacctattctttggtagtaggtatgtttatggtgttccccaacccatatcagtgatctttggacaaggctaacccaacaatgtggtaataatctatttccattttttcccccttaattaccagaattatattttctttaaaaattatgttagagtttccccatgtggtgaataccttgtatagctccagtggtgagcaaatgagcatactggtttaccatttagtcgttttatattttaaatgagtggtgcttgcagttgatagtatccgggtaaactgatgctagactaagacagcatgtttgtggtgaagtacttgcaaataacattagaaatcattgatttcagtttagaaataaaacacaagctacaaaaattttgctggttgatttatttttaagcacaaaatcaagaattccaactatgttacgaacattttgaggcaaggactacttcctcagatgtgaatgagagtccatttctgcctgagcagcattctttgtaactaaaagccccaccggctgaaatattttgaaatatttttcttcagaaaagtagagaatttgactcctaattgtgttcatgggactgttaacatagattcaaaacagaactattacttgcttcattttggctatggtcagatgaaatagtaggttttaaaaggaaattccagtgatagtacggaactagctagctagctagtttaacggatttattgttttcggtcacaatttgacatattgttatttaaattttaatgtaaacctgtgttaaacttttttatatcagtttttttatctacatagttaagtttgaggcagatgtctgtcatcagttggtagttcatttaactagtatttactggagatagaatggaaaaaactgctcctttggttctcttaatttttgttttgtgacggagtcttactctgtgatccatgccggagtgcagtggtgggatcttgactcattatgaactccgcctgttaggttcaagcgattgttgtccctcagcccccggagtacctgagattataggaatgtgccaccacacctggataattttttctatttttagtagacactgggtttcaccatgttggtcaggcccgtctccatgtcctggcctcaaatgagccgctcgccttagcctcccaaagtgctgggattacaggtgtgagccaccctgtccggcaaaacagattatttcaatctgttcacatttttaagatgagaatcagctgtggtccattaaatggtccatgtaccaaatgatagctttattattaatagattaacgtctactctggtgtagtgttgacatgtattactaggttttttgagacccaggaaatgtcactgtttgcagctaatgtcttatggtcagaatttccatttaagaagcttccctttgaaaacctcttcttagtacatgtcttgtaatgcttttactttggaattggggtagacattctttgtctttttttttttttttttttttggtggtggaggagacaaaagtttttactctgtcgcccaggctggagtgcaatggctgtctgcaacccccacttccttcctgggttcaagcaactctcgtgcctcagcctcctgcgtagctgggattacaggtgtgccactgcatccagctggtgtgttttgttgttttttttttctttttcttttccttttctttctttcttcctttcttttttttttttttaagacggagtcttgctctgtcactgaggctggagtacagtggaatgatctcagctcactgcaacctctgccttccagattcaagcaattcttctgcctcagccctcctgagtagctggaattacaggcgtgtgccaccatgcccggctaatttttgtatttttagtatacacggggtttccccatgttggtcaggctggtctcaactcgtaacctcatgatccacctgcctccgcctcccaaaatgttgggattacaggcatgagcctccacacctggctggtgtattttgtcttaatctgttcaggtgattaatgtctctagagtgttttaatttcttaatctgactagattttataccaacaccatcaagtttgattatgggtgcagttacaattctcctagggtttagtccttgttcccctggtaaaagattttaaacagcctagccttaatcagtaagtaatcagctattgttgcctcatctattgtatagctttctcatagtgagaatttccgcttaatttttagctggtgcttgaagtagtcatactgagcttcttaatatatatcccttttaacttaaaggttgtcacactatgtatgttttttttctattttcacacttaccgtcctcaacatttttcgaggcaaggactacttcctcagatgtgaatgagagtccatttctgcctgagcagcattctgtgtaactaaaagccttaactggctgaaatattttgaaatatttttcttcagaaaagtagagaatttgactcctaattgtgttcatgagactgttacatagattcaaaacaaaactgtattacttgctttattttggctgtggtcagacgaaatagtaggttttaaaaagaaattccagtgatagtacagaactagctagctagctcattggtttagatacgggtgccggtgaaggtttgtggcttaggaggtagattagatatttatttccattggactgaggcttaagctcagtttaatgctcatggatatggataacttattttgattcacctccagaaattgtcgttaagcaatttgtgtttgtgcaagtgttaccatctctcacaaaggatatgagtttctgaacactgatattttatagtttctgtatcattatactttgcaagattttggtcaaaaagaccaaaagctttatgtcaaaatgggaaagtagtgataataaaaagttactcagtatctttttctttgcattaattcccatgaatggattaaactaagagattaaccatacttaggggaaatgcaaacttttttctgttttctttttttttgagacagtgttgctctgttccgcatgagtgcagtggtgcagtcatggttctctcacctcctgggctcaacctgtctttccatctcagctttccttgctcttttaatttaggaaaatgttcctgtccatagccactcctgggacaagattaaacattgctttgttgaaatagtgtggaaacacttttaagttaacagaggagagaattagcaatgagatcttgtaaatgttttcactacaggaagattggagatattacaactcagaataacttgccactattgtatatatataagagggagaatcatgacaaaggtgattaataatatttttaaagttcttgactatcacatttgttttttaagaaatatttggagttagaacagttggtaggtgtatttttatagagtacctgggcctttgcattaagttagttgcatttttaaaaagcttgcagaattgaagaccttttcatacgttgccataggttcttatatggaaatgacaatgtggaatgtagaaagtttagaactgatgtccatgtaagaagtattttgttctgttttgaattttctctttacaaatgtaagtgtaccaagccactgctttggtgtatctttatcaatcactgggatactaagtttaagacatttgaaattaagatttctaatagaaacagcaattagttgagcaaccagtgtttattgagtgctaagtgtgtactggccagtgaatttagacataggtgagtagtgaacaagatagacagtggtctctgccctgttggaattaagcgtaaatttagttagaaatgatactacctgtttttatatgaggtattttttatcagtagtatttatacccagccaacacattttgctatgattccctcagttacatgaaattgccctgattttatagatctgaaattttatatggttcaaccttatatcactagttgtaataattcgtgtgcttctgtgggtgaaaagaatcagagatttcgctaatgccatataccactgtttatatacccttttaattggaacattttaaagagtatttgaccgtatgtgaattgtttattgtaatgtatatttgaaaataataagatccaaaggctattcattataataaatgccctgttaatactgacactagtacagaggaatcatttatatccagtgccaaaggccagccaaccatataatttgatatatgttttattttcctgaggaaaagttgctacagtattacaactattttatgtgcctaggtaaagaaataatgggataagatttctaaaccccactgtggaggtttttgctggccttcttaatgaaatttaataaaaggaaacgactagagacaatattcacttactatttatcataaggtctgttgaattgtgctgagttaatgttaggtttgaatgaattccattttcctcttatccaataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagtgtatgtattatttcattttgtgattttggtatctcttgtgttttgagatagggaagctaatgcagttacaatatttttgtgccacatgactttgtgtattcaaaataatggaagaggctgggtgtgtggtggctcatgcctgtaatcccagcactttgggaggcccagcgggtggatcagctgaggtcaggagttcaagaccagcctgtccaacatggaggaaccccatctctaccgaaaatacaaaaaatttgccggggatggtggtgcgtgcatgtaatcccagctaattgggaggctgaggcaggagaatcgcttttacccaggaggcggaggttgcagtgagccgagatcatgccattgcactccagcctgggtgacgagcaaaactc

SEQ ID NO: 9044 - DNA, 1259 bp, Homo sapiens
tgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattcacctgtgaccgttcattttcagttcttgaaagcaagcctgcttcctgcctggtaaagtgctaaggtactggagaaaaatgcctttagctagctagttttacaaatgaaactttcatcattctaaactttcatcattagattgagagacactagacatcacagtaaaccaaattcatgttatagcaagctaactttataagagactttttactatggttccctcagagacttttagattggaatagcacttgttccttcatgaaaacaaatcttcagtcatctccttgtaaatagcatggaggacagcagctgcttgaagggaaaccttcagccttcctattggggtagccagatcttcagggctaacaactgttgggaaagggaaaaaaacagcat

SEQ ID NO: 9045 - DNA, 1223 bp, Homo sapiens
cgcagtggctcacgcgtgtaatcctagcactttcggaggccaaggcaggtggatcacctgaggtcaggagtttgagaccagcctgaccaacatggtgaatccccggccctactaaaaatacaaaaattagccaggtgtggtggtgcgcgtctgtaattccagctactcgggaggctgaggcaggagaatcacttgaatccgggaggcggaggttgcagtgagctgaggtcacgccattgcactccagcctcgttgacaagagtgaaactctgtctcaaaaaaaagaaaaagaaaaaaaattgtagctcctgacgagaggttagaggttagaaggataaaaactatatttattcattgtcaaacattttagtgtccaaaagattcaaagcattgcccagccgtttactaggttagaaaatgaaattgcctcttttaaataatgtgtcttcattctccttttaattctaggatggcccagctactgttctcacttctgtgaagaagaaagtgaagaatgtggggattttcctaaaggtaggaagaagatagataagtagtataggaagtttaggatataaagaagttaaataatattggctaaaataattaaaatttcattttttgattatgactttttccatagaatgaagatgaggaagaagaggaggaggagaaagatgaggcagaggaccttttgggaagaggttctcgggcagcattacttacagaaagaacaagagtaagtttactattttaaattacattgatctcggctgtcatatggctcacgtgttgtgataaattggattttccattcaccagaatgaaatgactgcagaagagaagcgaagagcacatcagaaagaactagcggctcaactcaatgaagaagcaaagaggcgattgactgaacaaaagggagaacagcagattcagaagtaagagttttcactgagcagtgagatcatctgagggttctgtgggactgcagaaatttctcagttgtttttttatcccactccagagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaaggtactgacattcagtgcatcaggtttcatccaaactgttgcttaa

SEQ ID NO: 9046 - DNA, 1258 bp, Homo sapiens
gggcaagataacaaaaccccatctctactaaaaatataaaaaattagccgggcatgttgtcacacacctgtaatcccagctgctcgggaggctgaggcatgagaatcacttgaacccgggaggctgaggttgcagtgagtgtagattgcgccgctgcactccagcctggcaacagagcaagtctgtctcaaaaaaaaaaaaaaatttatccaggcatggtggtatgaacctgtagtcccagctacttgggaggccgaggcaggaggattgcttgaacttgggagttcgaggttgcagtaagctgtgatcacaccactgtgctctaccctgggggtagtagaacaagaccctgtctctttaaaagtaaaaagtaggtggggatgggaggagaattaattttttccgtagtttagaatattattctacctgttactggtaaaacgtgtctaatgaactggtaaaacatatgtgtcttttcttccctatgacactgacagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaagtaagaatactactggaaatagcaaatcaagagttgagaagacagaaatgtgatgggcttccataacagatagtgcaggacgtttgttttgggaaaactgtatgtttgtttacattttatcccctttggctgagcagtgtgccagttttattttttttccctgcctttcttctatctgcctttacaaaaaacgtctagagggcagtttacattttaagtggtacattagcttaacacctcttgtagtacacacaatgacctggcaaagagctatttcaaatgtttattcagttcaagaagagaatgtttgaatattctgcaaaccagtgatagtttgctaaataacagaaatatcactggtaatattcaaattggagagatgcatttattttgtaattctgtacttgcatgttagaaactcttgtcactttgactgcagatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgaggtaaatggagatgagagggtct

SEQ ID NO: 9047 - DNA, 1223 bp, Homo sapiens
aaatctttctaaggaaaaagtgtgtatgttttcttgtatttctaattttaccctttagtcagatggccttccttctcaccatcattgggcaagaggatgacctatagcccacatccctcaaagcttaatctttactttgaaaaacatgtaccatatgatgtcttgggtgggtgggttgtcttcctaggaggaaggattgaagttaacattccagaagcacaagttgatggcgaatggagtaatgggagatggacatccactgtttcataagaagaaggggaacagaaagaagctagtagaggtgagtggtagagaaagtctttaacctgacgattagattgtctttttattcccaataattgatgaaggcagtgggactgggggaatggaaaatactagagtcatttcatgactaccattggccctgctccccctccctccctcccccaaagaagagtatgtgctcatgggggtggattctgggtttgcagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcggtgagtggcagtcccatccagcaagatttaaagtcattcctttggtatttaagctgcatgagaaagagaaagcatgacatactgtatcatcgtttctgtatctgcaagataagggtaataattaataatacccagtcttccaacctcacaattgttgtgatgcccaaaataaaataatgttgaagtactttaagtgctaggcaaatatttactattgaactattatataaaccacctaatattttttggagagatcccacttaatggcagttttccactaggatgaatcctttatctatgtaataagtgtttattatcaaacaaaagacactagtactttaataattactccagagaagatttctattcctctaggataactgattttttctattgcagtatatggaggatcgcagaaaacagaagtggcaaagatgtaaaaaaaataataaggcagaattgaactgtttgggaatggaaccagtacagacagctaactctagaaatgggaaaaaggtgagagaaattgcagcattaccactctattcccac

SEQ ID NO: 9048 - DNA, 1225 bp, Homo sapiens
ccatctacaaaaggaaaagtagggcaacaataatcagaagaacacatcagaagaacacaagaaaactggttattttttaatgtgttttagaatatctgaaaacacaaaaattgaaagtagacgcaaaaaaaaaaaaaaaaaaaggcccagaagaggtagtgagaggtactctgtaatgagtaagaattacagagccaagggggaaaagacacagacaaatatcaatgaaaatgtctacacaggagacctacctgagagttaatgattactgcatgcaagtgaggttttaatttctacaggtttaactacccaaggcagaaaagatggtccctctgtagagaattccaaataaatccttcctgagatggctttcagtatagggaccataactgaaaacacagatcagcacaagttcccagctatattttaccgttgttgtttctcccgccgtgcaatttctttcagcttgaaggctgcttcacaacgccgccttcgccggtccccacgttctgcagcctctatcttcatttgttctctcttgtagctgcgctgatacgctgttactagacgccgaagcctagctgttagggcagagcccggaggccagaataaatggcctggctgttgggtcacctgggctgtggaaaacaaagtagaatgaataggaagtatagcaagggtagtagaggcaatactagtattttaacccacccaaaggcaaagctcttagaaatcccaggataggacagaattcagtgaataattccccaacccaccaccccacacagaattatactagttgacctagaagtttaccttcatctccatcaatcactgagatctcctcatccatcatcatcaagggatcaccctagagaaggagatccacccaataggatggagcggggagggaaagggggggaagttggcactctgaaatcactttcttgtgtgtgtccttctatggcaccaagggatcaagaaaaacttctaaagaaatatatccccacaaaaacttggaaacaatcaactaaaagaacaagaaagtagaacctgaaaggtcagttcctattaacgactcaaagataatagaagtcaggaatttattagtcaaataatatctttcagtgtccagctcctccataaagttatccctgatctccccctactggcattacagtcctttccattaatattttctattctcaaatggtataattcattt

SEQ ID NO: 9049 - DNA, 1213 bp, Homo sapiens
tgggcatggtggcatgcacctatagtaccagctactcaggaggctgaagcgggaggatcacttgagcctaggagttctgggctgtggtgtgctatgccaatcaggtgtctgcactaagtttgacatcaatatggtgacctcccaggagcaagggaccaccaggttgcctaaggagggatgaattggcccaggttggaaacggagcagggcagcactcccttgctgatcagcagtagtgttgtgcctgtgaatagccactgcactctagcctgggcaatacagcgagaccctgtctaaaaataacaaaaaagattgcatcaagacagataggatgatgaacaaagtgagttgtactgtgtcttctgacctgtagtttttatgattctagcatgaagaaaactggtgtaaatatttcagagtataccattctttaatgttgtactcttgcaatttcctttcttcactttagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggtgagagacttacatagtaaggaaaagaaagaaaacaaaaatacttagtccattgctgttgccctcagcaaccacttattcttgaatgtggggccattctagatttatatctctgaactgaggtgcagacttaattctttcattcatggaaaccttattttaattatattattaaaagattagagagggattgttgggtttgggatatgagattatttagtatttatctttgaattgttttatttataatcttttcctaatattattgtgaaataaaaatgatttgtgatatcctttaaatgatagttcagaaatgacttgaagaaataagtgatcagtcctcccctctccccgcccaggcagataaaaggt

SEQ ID NO: 9050 - DNA, 1198 bp, Homo sapiens
ctgcggcaggataatcacttgaacccgggaggtggaggttgctgtgagccgagatcgcgccattgcactccagccagggcgacagagtgaaactccgtctcaaaaaaaaaaaaaagaaaaaaacccccaaaactgtactatatggtgttgctctctacgagtgctactttaacacaagtcaactctcaggactcctctccgaatattcaacatggccgcatgcgcgtctataagcaacatggccgctctgccagtcaccaacatggcaaccacagcctcactgtgtccggaagcatgagagagcgggtatgaggactataccggccgctctgccaacacctaacgtggctctttatagcttccaagaaagcgcgacaccggaaatgacttttctgtcttgctcagctccaggggtcattttccggttagccttcggggtgtccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttgggtgaggcactgggctgttggggccgaggctcaaccggggaggacgggcgggatccctagagaaaaagctccagagtcactgccctttaccaaacggccatttctataaagcctcgtacattggtactccctctccaccttcagcagcagacgttcgcccttctgcaagtagttcgcggttcctcctcacgctgggcctcggttcttccagctcacttttaccggacggacgcttgagccccaccctcgtccgccttgcccactcctcttcagactgcgaggacgtcgcctttgtgaggctgctcagccccctatcccgcgaagcagcaagaacccctttttgttgctgctttggcgctttgttccctcagttataacgactcttttgtagtggtcatttcttggcagctgtgggtacagtaagcgaggaatgaacctttatatccgcagtgcccaatttagtggcccgtacagagtggcactgggtgtttctgaatgagtacccctaccggcattgacttagccatttacatacctagcaggaatctgaaaacatttgtgtttgg

SEQ ID NO: 9051 - DNA, 1344 bp, Homo sapiens
gcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctccatatgcctctggctctgtttttattctttgctggtatcagaatcctttttttctcttcagtcctctgtgctgaactctttatgagttggtaacttacagctgtgaacctgcctccttgttttcattaagtatatttgaagttaatggcaaaaggcagtgctgacaaccctgggaaatggcagtcctttgtcttcttcctggagcaggtaatcctttactaatccttcgattgttacaggtgcttccactcttatgacagtgcattcctggaactgcatcattatgcactctgctagaaattgaactaagtatgtgctaccacatttacatctgtttcaacatgttttagtggtaaaagtgaaatatatttctcttaggcagtgtagacagagtgaaaaatgggggttatgtatgtgttgacttataagatacaatattttccaaagcaccttcacaaatattctctcattttattcttgcaattatcttaggggttcctgtcctcattagttaggtgaagaaattgaaactcagatttgtgacttgc

SEQ ID NO: 9052 - DNA, 1366 bp, Homo sapiens
tctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccagctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccttgggctccttttctatattaataaagaaacgagtaaaaattaccggtggggatgatgtttaaaattgctctgatcactggtggtgctgaattcgcaacagcctgtgtgatgcctgagagaagggagtcctgagggttgcctgcctacccacgactccttctccttttagtgtggcgtttgcccgctagacccagcccagagtccaggtcagcacaggccctctcagccaaccactcatgacaaatgaggagtcgagatccacagtgtggatggggcaagccccagttcacagtagagaggtggagcttagtactt

SEQ ID NO: 9053 - DNA, 1166 bp, Homo sapiens
gaggctatttttaaacttacaaatcagaggacaatcgcgacattagaggaaaattacccaggtttacgccatcactaacgatgatagcttacgatgatagctaacccagctcttcaacttcctttcaatctccagaaaaggctctctgcgtgctaatggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggttcgagcttcgctctgcaggcaccacccgctgcatgccttcgggctagcggtctgcgcgcggtgatagcaatgtcctcccctgtagtggccgagctgcctgcttcttggggagttagcataatgaatcccgtttgcacccacgcgaggacttctgctcccggtaaaggggctccatcatccttttacacgctcaggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggtaagaggcctttcgttcctgcaatattaggagtggtgtttcctggttggtttcatattttgttttgtttgggagcagggggaatatggagcagagttcttgtccacgctccacacagctctc

SEQ ID NO: 9054 - DNA, 1337 bp, Homo sapiens
ctgttaagaatcctgagttgtccactccagttatgtttcctgtgcccttagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtgggtaagccgtgcatccttaagtccgctcagctattgcagagcttggtttttgcctttttctgtaaatccagcctccaaagacatctttgccttagccccttcttatgaacccttcggcttagtggaatcactcccctcacactgagttccattcagtgacacttgaactcagcccagctgacctcttctcaattccaactcaaagttctctttgtagggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaagtctgagtggcttcattttatatagtatctatctctaggacagctcccattagcctagaaacacaaagactaaaatcaatcttatgcttgaaagtatatccatcttttctctctcaagctagctgctgaaggctgataaaccaggctctacacaaaggcagacaacagaacacttaaactgctctagtcaaatgttggattgttacataaaaatgacatgaacttcctttttgagacaggatcttgctctgtagccaaggctggagtatagcagcatgatcttggatcactgcagcctcaacctcctgggcttaagctatcctcccacctcagcctcccaggtagctgggactatggacaagcaccaccatgctcagctaactttttagca

SEQ ID NO: 9055 - DNA, 1135 bp, Homo sapiens
tcaacctactcccgggttcaagcgattctccagcctcagcctcctgagtagctgggattacacacgtgtgccaccacacccagctaactttgtatttttagtagagacagggtttttctatgttggtcagactggtcttgaactccccacctcaggtgatccgcctgcctcagcctcccaaagtgctgggattacaggtgtgggccaccatgcctggccccagccaaaggttttaatagcactgtgagaagggaggaagagagtggggcactcccaggacaggaaccagtagtagacatcctgctgcacattttgctgtctccctctgcttcccaagccagaactcgctcccactggggagtcagcagcgtcattttccagatgaaacctctgaatttgtaagtggaaggatatatagtatagcgctgaagtcccagatgttatccacactgttttcctgtctgtttcagagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagaaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcga

SEQ ID NO: 9056 - DNA, 1569 bp, Homo sapiens
gcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggcgtctgaccccaggaacctgcagggcggggctgggtcggtgccctctaaggacaattttgaccttgttcaacctttccacaaagaataaattgtgtttcacattccttgtgtggctgagctctgtagagggtgacgggctgtgggtgagaggagctggatgaggggcgggcacacatcataagcagcgttttccatg

SEQ ID NO: 9057 - DNA, 1141 bp, Homo sapiens
cttcctgggacacaaggggcctggtggcaccaggggaggagaaagccagcagcagtcaagagtatctcatgtcctgctctcctctactcccataggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaaggtaggctggacagggatgtctgaggagcaggcagtgaaagccccaggcagaaggggaggatcctgagggttctggtgcttcacagcccctctccatggtgcctctgcagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccag

SEQ ID NO: 9058 - DNA, 1271 bp, Homo sapiens
aggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaat

SEQ ID NO: 9059 - DNA, 1200 bp, Homo sapiens
actctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgacacctgaggagaaaaaaattctacttgtggatatccatcattttctccttactcatatgtcccatggctgtgttttagggagaaattgaggcacagtacagcagagttgatatcccccaaggtggtctgaactcagcagcctagtaggctgaactgatggcagctgaaagggctgtgcaaaatcaagatagcctaaatccagttgcttggctctctggcactgctgctgtctttacatgattctgggtctgtcgcggttgtaggtttgatttcctctgcatgcctgtcttccatccgcgtttcaagagggagttcattcaggaacctgctaagaatcggcccggtccccagacacgatcagacctactgctgtcaggaaggggtagggaccatcccatatgccccttaattattagaggcaataacaacttctgctttatcggggccctcattctcctccttttctgacttggatatatttgttagtccctgggatatagataacttgttttctccttgcttctctattctgcatcaggctatcccatgtctatgtagaaaaaacctttgtctctcatttctactcttgattcccaaaactaaaaattgaacaagtaaagtgctgaaccttattcagtatttgtctttcttgggtgggggagtgcagactggaatacgctaattgtgggaaagctttctccatggattcgtccagactcaaaagtggagaagattcgcaggaactccgaggcggtaagactgtttgacttctctgctggatttttctaaccaagctgggtggggagagtggtcccctcccatccccaataacttggtaaattaactgatagaatgaaattaaagctattaggctgggtgctgtggtgcacacctataatcctagcactttgggaggctgaggctgtaggatcactggagctcgggatttcg

SEQ ID NO: 9060 - DNA, 1231 bp, Homo sapiens
gaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaaatcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcagaggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaat

SEQ ID NO: 9061 - DNA, 1207 bp, Homo sapiens
gaagtcctatcatccaggctgtttccgatgcattgtttgcaacaagtgcctggatggcatccccttcacagtggacttctccaaccaagtatactgtgtcaccgactaccacaagtgagtctgccccttgggatgcagtgtggaactgggtccagggattccccagcctcagctcatctcttccctctctctttcagaaattatgctcctaagtgtgcagcctgtggccaacccatcctcccctctgaggtcagtatgtctgggttctccttcagggcagccagtgccactgcctttggggaggggatagggacatgctgcctggcctcctgccagaagtggtagtgccaaggaatgtactctgtgaagattcccgtgtgactctgcctcttggggtcaccaccctgaccctaatatccgggcctggacatgtctgaaagcctaactgggcccaggctccatctcttctatcccagtccagaggaggagactttctttgaggtcgaggtcaccagactgcagatgtaggggctggaaaaaggtgggaagaatcctcagcactggtaggaaggggtcagaaatgatttaagctgagtgtaggggatgtgcctatggagagaaaccaaaagccagtgaggaccagatcttattggatccccttgttcccagcctagcctactttatttaggcctcctgtccccttcccttccctttgcttcctgcacaactgagagacgcaggtaaggccagggctgttgtacagagggagtgtgctccatgggtgcagcccagtgaaggagatgagagttctggtaggatttgcagaagcatcttaaaactacaggtgattgcagagagactctgggggcatttgtatgatcttcccatggggtgggaagggttgtatatgagggaaaggtggaggtgaggcaacatgctgctctcatctccatgggggtctgcatgtttcagggctgtgaggacatcgtgagggtgatatccatggaccgggattatcactttgagtgctaccactgtgaggtgagtgttggggttcagcggtgctggagaagaagtggaaatggggagaggggaggagtcaagtcctgcaacaaccagacatctatgggagaggtgtagggcatgggaaaccagaaagatattgtgacctatcttcagtctcttttttgtcctccagccactctct

SEQ ID NO: 9062 - DNA, 1166 bp, Homo sapiens
cctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggcccttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccgggggtaagtcgggggaggaaggtgaggcctcttgggttgattcctaggcgaccccaggttgctgctgttcaggatcttctagctgggaaaggccgcaacaacaatgaatcttggccgagggaaggctattgtaaacgtttaccaaagttttggaaactgggcggcccctcaaggcaggggtaactgaaactggcatgaaggggaagcgtggtgagggtaagcattgtactaagaat

SEQ ID NO: 9063 - DNA, 1115 bp, Homo sapiens
ggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtaaggcttctgcaccccagtgtcaggggaaaggtgggagcagtagatgcagagcagctagctgaggagctgagataaagtctttggagggaacttccctgtctgtgcagagggttgggttgactgacactttcaggggtcagactaccaaatccagctggctacctgttacaaataaagtttgattggaacacaaccacacgagttcattcacttttgtctgtggctgtttgttcactacaacatcaccagagttgagtagttgcaacaaactatgtggcctgcaaaacctgaagtactgctttgctctacagaaaaaatttactaactcctgtcttagttttcctcaaggcaaagttgaggcactaacaatcccaggatctggtagaagtgagccgataacgaaatacccctagcggaaggaacatgctagattgactgctactcttaccggggaaccagaggctgaaaagaatatgccagtttggtgtttaacagacctgctgtgtt

SEQ ID NO: 9064 - DNA, 1220 bp, Homo sapiens
aaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaagtgagtatgagagaatcccgggtgtattaatgttctgtcatattccagtggttttcatttcagcccctggagagcctgtcatgatttctgaaaggaataggaaaagcctcctttactctccttcactgattactttctcctcatttcagaatcgtattttcaattaactgattcccgaaatggggttctttttcattttgagtcccttgatagaatgttgaatttatgtactcatctcctccactagatggaaacttcttgaggatgtgggcatgcccttttacgtgtgtgtcccaggatctagcatctagttaaaacttaataatttgttaaataagtggtcaaggagaccactaaatgggaataaacacagacaaaatgggagtaaacacagacaaaaaggtccagagtataaaatttggtccatggaaactggaaaactcagcaatctactgaatatataccatatacaataattttccttgttatgtgtttcattttgttttagtctctgagccctggagtctccagggacagcagcaccagctatactgaaaccaaagatcc

SEQ ID NO: 9065 - DNA, 1176 bp, Homo sapiens
tcctgatatccctttctccttctttctctcctgcttcccttctctcccacaggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtgatgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggtt

SEQ ID NO: 9066 - DNA, 1484 bp, Homo sapiens
ctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggcc

SEQ ID NO: 9067 - DNA, 1175 bp, Homo sapiens
tacctaaggactcgataggaggtgggacgcgtgttgattgacaggcagatttcccctaccgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacggttgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatggtgagtaactggcggttgcacgcggagcccgggttctcgggttggaagggttgtggggaggatggggaatgtggggttagatactcggcaccctggagctgcttgtctg

SEQ ID NO: 9068 - DNA, 1175 bp, Homo sapiens; identical to SEQ ID NO: 9067

SEQ ID NO: 9069 - DNA, 1484 bp, Homo sapiens
tgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaaggattatttatcttcctattctctcttagatcgcagatggctattaattctgccttgtggtagaagtactggtgttgtggaagggaggttgccacttgtga

SEQ ID NO: 9070 - DNA, 1484 bp, Homo sapiens; identical to SEQ ID NO: 9069

SEQ ID NO: 9071 - DNA, 1180 bp, Homo sapiens
gaatggaacagcaaacctcccaaggtaccaggaaaggggactccatgggccaacaaggtctgaagatgactgaggccaaggtcaactgccttggtattgagtgggtggggtctggcttaaacgaagttccctcctcattgtactttcttctctctcccctagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcacc

SEQ ID NO: 9072 - DNA, 1697 bp, Homo sapiens
ggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcgagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaccagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccc

SEQ ID NO: 9073 - DNA, 1323 bp, Homo sapiens
ccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaa

SEQ ID NO: 9074 - DNA, 1323 bp, Homo sapiens; identical to SEQ ID NO: 9073

SEQ ID NO: 9075 - DNA, 1122 bp, Homo sapiens
cagcctcccaaagtgctgggattacaggcatgagccaccgtgcccagccatctccctacttatttctaaacgttgattaaacagttaaacatgggcatgggctacacaggcagtaacatcagcatgcctacatgtatacttccacacagccaggcatgtgccttttttgctcatttggccatatctgtccctcgctgagcaggagacaccctcctcaagcctcataaaggctacaagatacatgtgtcctgaacacatcccacacaccaactgcaacctgctcttcatggtccctgcatgcagacatgttttagcaggctgcagcccaagctttctgtctctccaccacctgccttgtccactctcgatgacagcaactagctcattgcctctgtttctcctataggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactggtaagccttgggctccacaacctgcaggataggtgcactgaggccactttgggttcaccaaggcaaaatcaacttaactagaacatcccaatggaatgaacaagaatgagagctttggggtaaacagacccagaaactgggatttgcttacgcctataatcccagcactttgagaggccaaggcgggtggatcaccaggtgtcgggagtttgggaccagcctgaccaacatggagaaaccccgtctctactgaaaaaaaaaaaaaaaaatacaaaaattagcccagcatggcagcgcatgcctgtaatcccagctacttgggagggtgaggcaggagaatcacttaaacccaagaggcggaggttgcagtgagccaagatcgcgtcattgcactccagcctgggcaataagagcgaaactctgtctcaaaaaaaaaaaagaaagaaactgggatttttttttttttttga

SEQ ID NO: 9076 - DNA, 1192 bp, Homo sapiens
ggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttca

SEQ ID NO: 9077 - DNA, 1178 bp, Homo sapiens
agacccggcacgcctccacccagtgtggggagggaagcaagggagaatatgaaactgggaattgggtagagggctgatgtggcattatgccattccctcttcccaggtcaccacctggttgcagctgcagatacctcggattgaggatggtaacaattttggagtggctgtccaggtgagagcgctgccccacttccctgctcttttctagtccatgcttccttccactttcccccttgctttttttccctaggagaaggtgtttgagctgatgaccagcctccacaccaagctagaaggcttccacactcaaatctctaagtgagtgaccacccatgtgcacactgtttttgttttgggagacctccttcttctactccatacacacttctccttccacaggtatttctctgagcgtggtgatgcagtgactaaagcagccaagcagccccatgtggtaggtgaggcccaggtcagggtgcatgggggaaggacacatgtaaggtcaggcctgacccgagcttcccacagggtgattatcggcagctggtgcacgagctggatgaggcagagtaccgggacatccggctgatggtcatggagatccgcaatgcttatgtgaggaggcaagggcagggcaggggtgggcagaggcagctttcccaggccacccactccctgaccctgcaggctaggggttaagggtgacaaagctcagcttctccacaaggctagaaatggggcacagagccactggaggcctctgactgacctctactccctggccctgtaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatcagcccaagtctctttattggaaccgggccccgctggccctggctcaggcatttccatttccattagtgggaccaacccactgggtgatttgagtgttgagccgctggttggtccagtcctgccggatgtcatcaaggtggcagtcaaagtccac

SEQ ID NO: 9078 - DNA, 1162 bp, Homo sapiens
cagtggctcacgcctgtaatcccagcactttgggaggctgaagggggtggatcacctgaggtcaggagttcgagaccagcctggccaacatggtgaaaccccatctttactaaaaatacaaaaattagctgggcgtggtggtgggcgcttgtaatcccagctactcaggaggctgaagcaggagaattgcttgaacccaggaggtggaagttgcagtgagctgagatcgtgccactgtactccagcctagatgacagagcgagactctgtcaaaaacaacaacaacaacaacaacaacaacaacaaaaaactcctaagtcttctttttcttttttttctggcttccttttcctgcaggaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaatctttcttctgttgcacaagttgactgaaataaaaatggacctaatgctcactcagttatagcaggctgaaggaatcggacagtggaaggaatggtgctcttacggggattatcagactctaggaaaacctacttagtggtgtgttggaaccagttcctagtggctaatgagagccaattattggcacctttttccaactctattaagtgacttcatgttggtagcttgaaattggccatggtaggattatttacagaaactagcaaacactacagatcagttcctccccacaaactggttgttatacatctaccagtgtagtgctgacatggatggtgaaaccttcggagagtgaattctctcttgactgtggctgtactggacatttaggcctggttggagaacgccttcaagggtttggctgacactgtactcta

SEQ ID NO: 9079 - DNA, 1193 bp, Homo sapiens
gggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaatactgccttgatgtgaaggaggggaattaaggtttccataaggtcagcataagtcattccttagaaacagaactggcccttccaaactgaaaggatccctttgcctttttttacttcccttgctaagtgttgttcagctgtgcctaaaagggttagcagggttgaaagcctggaagagaaatgtcctttggtattctggaaatatgtgtcctcaggccagaatatactttgtaaattctcatgctgccagattatctgggtgtggtggcactagaatggagatacttcatgggaataatactcattgttcttgaccccactgggtcagtgctgaccctaccaccacccactctgcagcagcacccagatgctagccttgtacagaaagccccagcatctctttacagtcaatgagctctctctttattgaggtatttcaaatatacaaacacttcagagctttttagatatgtgaaggtccaatttagtgaagcggattaacaaaacatgattctaaaagcctgcctcctctagaccaaggccatgtaaaagatttat

SEQ ID NO: 9080 - DNA, 1386 bp, Homo sapiens
caggggcaacagcgcgcagagatcgcagaaactccagtactcgcggaaaatgttccacgcagcgtccgcgcacaacctgccagctagccgcggcggcgaagcgtagagctgcgggacccgccaccaggggcgtagccatggtcggcgggctccgcccggaggcggtccctccgggttcctcacccggatgggtgaggctttccgatcactcctaggggcggggcttctggcaactccctgtcgctccggtctgtcggctctgggtacctcgcgatctgactcggctcccttccatcggcccccagaattctgggggagggggtcttctggctcgggctggaggagcctgagtggagaagctgaccgtctccagtggcactgggtcgctcagctttaaacgtcgccgctgtctcgagcccgagggtgcctcacttccggctccgctactagcttcccttgccccggaaaagggcggtaagagggagccaatgggcggccacagagggaaccgtgacggtgcgtcagaaggccacgccccagcggagctgtagctgcccgcttcctgcactctctgccggctgacatgagttggcggctgaggctgtcgtggccgctgaggctgttgtggccgttcgtctgggtcctcccagccttgctttcttcgcggagcctgcggagaagccccgtcactcccgtgaggctcgacttcctagtctgtaaaacgaggatcatgccaccgccctttcccactgtcttcacccatcgaaatttagttctttaaattccagacccgagccggcgtctacaaagccttcccctctgcgcgcgtcgcttccagtaggaattcgactgttccttttataaaacagaagagggcgcccgcccttaaaaaataaaatacaggctgggcgtggtggcttgtgtctaatcccagcgctttgagaggccgaggcaggagggtcacttgagcccaggagctccagacaagcctgggcgacatggtgaaaccccttctctgctaaaagtacaaaaattagctgggcgtggtggcaggcgcctgtaatcccagctactcgggaggccgaggcaggagaatcgcttgaacccagtagacgggaggtggcagtgagccgcgatcttgcctctgcattccagcctgggcgacagagggagaatctctctcaaagaaaaaaaaaaaaaaaaaaagaggaagaagaagaaatagaatacaggctgggggcacggtgactcacacctgtaatcccagcactctgagaggccgagaggggaggatcgatccgcttgagcccaggagttccagaccagactggatcacatggcgataacctgtctctactgaaaatcaaaaaaactagccgggcgtag

SEQ ID NO: 9081 - DNA, 1183 bp, Homo sapiens
cacccaccccactggttaccccactcgcagcactgtctgtcccacgtcatgtactgctgtgggctgtaaggtcagcttcccacatgctcccatcctcttcttggctggggtccccaagggcctgtggggcacagagggcatgtgcctaataaatgctggccgaggaccctctcccaggtctcctgggaagcccatcacctccttcctcccttcaccccccaggatctgacagtgctctgccatctggaacagctgctcttggtcacccatcttgacttgtcacacaatcgcctccgaaccctgccacctgcactggctgccctgcgctgccttgaggtaaagtacccatgtctccgtccctgtcacgggtggttcttttcctcttcctctccctcagaagtctgcccatcctacaaggagatgtgcaggaccctccaccccgaacaggtaactgcgtgccttccacctccatcacgcagcctgaccctgtgagcccctctgtgctctgtggacccgtcaccctgagctcctcagttgctgaaccatccctggctgacagcgcctgtcctgcctccctgccctccctgcccccaggtgctgcaggccagtgataatgccatagagtccctggacggcgtcaccaacctaccccggctgcaggagctgctactgtgcaacaaccgtatccttccttctgggtgcctttcagacagtgggtaaagtgaggtgccaccctgggaagggacagacagcaggcagggtatgtgccaccctcttgcagggcaggagagagggggctctgtagtgtgagttgaagggggagagcctggggctgtcgggctatcactgacctgcactggtggagttgtgcggagtggacttcctcaagtcagagttcacaaatgggcagcccgcagctgttcttcaggtctatgtagttttttgaaaatcaggaactttcatactttaaaaaacatctagagttctaattcctctcttaaaaattggaagttagagcaaccttacactggtattttcactcagcagcccttggtcattgctgaatagtaaatgtctctttggaccaggctagatttccaccttatcataccctgcaccactcccctgatactacaccagcttgcgtggggtgttgcggctcattctttcctggctgaccctg

SEQ ID NO: 9082 - DNA, 1144 bp, Homo sapiens
ggacaatatgtggctctggcctgtagtcgccatggcagccgtgtgctagatgccatctggagtggagcagccttgagggcccggaaggaaattgctgctgagcttggtgagtaccagcccctctctttgatgtttccagactctcccctctcttactccagatcactgggtagctgggaagtctactgaaattcaacagtctttagttccaaagggtggtcttgctcatgggttcttagcagtctgctttccccttccctcccgctgactgattgtgtagtcctctgccctcaccctgccctctgacttctgttctttggaaagtgaagtgttcactttatcccagtggcagtcccagggtctgggggaaatggagggatctttacgtcaagtagagtctgtctttgagcatggtagtactaaacatgagtggttccctttgcaggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggccagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttag

SEQ ID NO: 9083 - DNA, 1148 bp, Homo sapiens
aggcagctggaaggtgtgcagtggggagactaccagacctctcaccagcatgtcctcccacttcctgtcttcccagtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctg

SEQ ID NO: 9084 - DNA, 1128 bp, Homo sapiens
tcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccc

SEQ ID NO: 9085 - DNA, 1196 bp, Homo sapiens
gctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatggagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgccct

SEQ ID NO: 9086 - DNA, 1207 bp, Homo sapiens
agacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaaatgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctgtccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactggagctgatgtccagttctttgtttagcttcagtctcaattgtgggaatgaggagtgtggggcagtcatggggtatggctgctatatgtttcccagataaacttgcagatttgaagaaaagtaccttttccagaccatctgccccaagctcttactgtacagatgaagagaccagggcccagagggtgatatgcttaaggct

SEQ ID NO: 9087 - DNA, 1146 bp, Homo sapiens
ctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgtgagtacctggtggggctaagggcctaggagagggaggatatgtcctgaggggctggcattgtagccagggtgccaagcccctcctctggccgaccccctcccactacaggcatggcctccagcactacttctccagccggggcattgccattgctgtgcagtacttctgggaccgtggtcaccgtgacataactgtctttgtgcctcagtggcgcttcagtaaggatgccaaagtcagaggtgagttgggcctggtcttcagtgtcccaggataggctctgtttccactttgaggagaaccctattatgttctttttcaatagagagtcacttcctgcaaaagctgtattccctcagcctgctctccctcacaccctcacgagtcatggatggcaagaggatctcctcctatgatgacaggtacttgctcctctcctggccccaggcttgatattgaaggagccctatggaagactgagggagagagaaaagctcctggtggtttacgctgtttctaagccttggtggtgggtaaggggccagttattcctctgtgtgccttatgattgggtaggtaaacctgccctgcaggtgtgatgagatgaactgtagacaaccatgtttgtctattcatcattcatcaaacaaaatgataccttgtatttatatagtgccttactgtctagaaaatactggtttagtggaaaggtgggaaagctggttacataagtagc

SEQ ID NO: 9088 - DNA, 2021 bp, Homo sapiens
tctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagcggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgctcattgtaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaactgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaa

SEQ ID NO: 9089 - DNA, 1855 bp, Homo sapiens
agtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagt

SEQ ID NO: 9090 - DNA, 1111 bp, Homo sapiens
taatctacaaccaacactcaaaggggagaggagcccacactttcagagcactgaaagaaagcctggctgcaaccttgaggaaatataggggagtcacaggactgagcaagagcctagcaactgatcatgcctaagcgtcacctactggatcacatcccaaagctttaacaccaaaaatacctcaataacagactcccctgtgaaaccaaagaaaataagtcagctacaaataaggactctgcacaaagccttggccctgtgaaaacatccaagaagaagtctacttcctgtactcaatttacgttgtaaataaaggaacacggctccggccgggctgcggggctccgctcagtccgggagcgcccccgggccgcggcgctcctacctctgctttcccaccgcccgcagctgaagcacatcccgcagcccggcgcggactccgatcgccgcagttgccctcgggcgccatgtcgcagaacggagcgcccgggatgcaggaggagagcctgcagggctcctgggtagaattgcactttagcaataatgggaaagggggcagtgttccagcctcggtttctatttataatggtgacatggaaaaaatactgctggacgcacagcatgagtctggacggagtagctccaagagttctcactgtgacagcccacctcgctcacagacaccacaagataccaacagagcttctgaaacagatacccatagcattggagagaaaaacagctcacagtctgaggaagatgatattgagagaaggaaggaagttgaaagcatcttgaagaaaaactcagattggatatgggttggtcaagtcggccggaaaatattccccccaaggagttcctctttaaacacccgaagcgcacggccaccctcagcatgaggaacacgagcgtcatgaagaaagggggcatattctctgcagaatttctgaaagttttctttccatctctgctgctctctcatttgctggccatcggattggggatctatattggaaggcgtctgacaacctccaccagcaccttttgatgaagaactggagtctgacttggttcgttagtggattacttctgagcttgcaacatagct

SEQ ID NO: 9091 - DNA, 1344 bp, Homo sapiens
agggctgtatgcatttcgagtaaatcaaaggcatgtaaatttgattgagtacacaaagtaaatattatgccctaggatacccctgaaaatatttgcttcctgagtacaactttaaacatcaaggttttatgaattttgacttttggtatcataagtattccatttcttttagtagttgtgtttttgacctatttaatggattgttatcatgtaagaaaactacagtttagaaaatacaaatggaaataaagtgaattgggaataggttattaattgcattttatgtgttatatgactaaactattttttaggcgtaagttcctgcctcccttaattttatacgattttgagcacaacgtatgcacccatttgttgaatacaataatgtatatactgtattgctgacaatattacacaggattctcaacataattattagtttctgaaattctgtataagtaagtctcactaccagaaaagttcagatttcgaaggtccagctctctccttggtcatagattgtgagacttaatttttagtgccaaggctccagtctgttgtaggtgaattatgagacagacacaaatgaatttcattttatatatgtgaattacagtgttttccaagttttgctttgcagttcatgagatttttttaaaataatttacatttttaggtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggtaagatacatattttgtaagctttctctgattgatataaaattatggcttgctgatttaaattttaaattagaaagaattgacgtgtatattacctcttactacttgttacttttaaaacagctttaaagcacttaatttgaagcagattttacatacaaaattcaccctatttaagtatacaattaacattcaataaatacttcagatgaaactttttaatgtatatttatacttaaagaattttgttgtttttacctaaggattttgtttgatttcacaatgaataaactagattttaattcctaagtttcatttacatatttatgctggaaaaccaggatatttgaaatgataagaagcttgatagcaagttaagatatttaaacattagtaggcttttcttcccaatggtaagcactttaccataacttcttaacagggagctgattactgtcaattaattaaaaatattggttctttgagagtcatcttacgtatc

SEQ ID NO: 9092 - DNA, 1100 bp, Homo sapiens
agataagtttaggtgaaaggcattctttctagaaaacattattgtcaccgcatagaacagttttaatcctaataatctatttcatcattttcaatttgaagttaaactaaattattcttcacccactggtcagggctataacaatgatatttatcattgagcattagcagtgtaaaatcattctgcctgatagagtggagaagaatttaacttatagttgaaattttgtttagctagatttttggttttttaccgtttagtctttctgtctgtatttgttatatacaataagtagttgtactaaatgattgtattagtccttctactttgagattcatttatgtactgtttgcctgttactacatctgactttgtgatttagtttgcccaaaacaaatgtgggagtctgtgcctttcagtattccaagtctatttggagaagaatctatgatgatagcaatatataacatggatttacttttgtttcttttactcttttattggtaaattttttcagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttac

SEQ ID NO: 9093 - DNA, 3134 bp, Homo sapiens
atagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggtaaactgcctatttaaactaagtaattttttgggatttaataagattaagattctgacgaaactgaaagatacaagattcctttactctccacatttgagagatcctataagcaagcagttagtgtctgacacccaggaacctatagaaatgagggaatctgtgttaaaactatgtatcctctaatgtaaaatagcttaccagaataaattatttaagccaaaaatctggactcagataaatggctatagtaa

SEQ ID NO: 9094 - DNA, 2213 bp, Homo sapiens
ttaatcagttctctgttatgttttgtttaggtaaaatgatccattctatggtagctcacttggatgctgttacaagtctagcagtagatcctaatggaatctatttgatgtctggaagtaagtcttaaagtcctgtactgcccacaaactttataaaagattgttactcagtaacaaattttatttgttcttttacaggccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaacactattaataatgtctaagtatttcaccccacttgaagattaagaaaaagtcttgcattaaattatgcaattcaaaataacccccagaaatgcacaggtgcagttttaagtaatttgcttagacatcctgttacattattaaatctgaattt

SEQ ID NO: 9095 - DNA, 1225 bp, Homo sapiens
ctttagttcagactttcagaaagtaccttaacttgctgcctttaataatttcacatgctaatacgttttctaaatgacaactttactgttaatactgtaccgttggatatttgtaataacttatgtaattatttttcatgtaaagtattgcagcaatggtagttattttgttctcatctgacatttaatgggagctttgggtttagcttaataggtaaaaacagattaaggaactcttcatttgacctaggctatttgtaaggcgaatgaaattattctgagttattattaaatgataaagtttttttagaaagttttaaaggtacattaaatttccactggacattttagccaacagttttaaatatatgtgttaaacacaccaaaaagaaacgaacaaacactccacatgccttccagtttactacttttaccactaaatattgtgctctttccttttagttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagcaagtattttagtgttagcctggtgtatttcttccaattttgctaatataagtaattattcctcattattgttgcatgtctttaatgcacacatttgatctaatgactatttaatatcaaccagtgattcatagttatttaattgccttctcttcccctaccctttttccccctcttttaggagtgcctctttagatgtagagcctatctacacatttagggcccacatgtaagttttactgaattggtatttaattaacatcatcattattgttaaatattatttatcggtcctcaaaccttgtaattttctcaatgttttgtattagaaaagatgtattacttgaataatagctatttaataattgtattggtgagactatgaatataatagtaccattcaggccagatgcagtagttcatgcctgtaatctgaggattttcggaggctgaggcgggcagatcacttgaggtcaggagttcgagaccagcctggccaacatggtgaaactccgtctctaccacaaaatacaaaaattagctgggcatgttggcgtgcgcttgtagtctcagcaactcagtaggc

SEQ ID NO: 9096 - DNA, 1170 bp, Homo sapiens
gatcctaggttaagttccttagtttagatatggtgaaagattgaaaatcacaggactggaggagtgctatgagatcttagatcctagaaggagaattagtgtgttcatcaatctctagttaacaaccccaggtttaaacttagtatgtctgtgtgctaagatgcagttctactcattctttactgctccttggaaattaaaaaatgtgtgtgtgttgtgtttgtgtgtgtgtgtgtaaattaaaaacaatgtgtggttgtgtgtatggaaatttaaaaatgtgtgtgtgtgtgtatataatcctaaaagcattttaagacactagggcttcttgggttttgagataattggctcttaatcagtgttaaccatactatatgctttttaatttaaattttggtttgtatttggtattgttctcttagaactggaactagtctgtagagaagaaagatactgagacaaagggagagcatattttataggattatgggtttttctaaaatttgatgtgattttgagtctggcacatgttaacagtatgtggattttaatatttattttctcttacaggtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtatgatttatacttaacatagtttatataatggatattatggatattgttattgttaatctctttagctccttgttactgccattaagaacttttttttttttttttttgacacggagtcttgctcttgtcgcccaagctggagtgcaatggtacgatctcggctcactgcaacctccgcctcccaggctcaagcaattctcctgcctcagcctcccaagtagctgggattacaggcacccaccaccactcctggctaattttttgtatttttagtagacacggggtttcaccacgttggccaggctggttgcgaactcctgacctcaggtgatccacctgccttggcctcccaaagtgctgggattacaggcgtgagccagcgtgcccaactgctattaacaatttttaaagcagatcgag

SEQ ID NO: 9097 - DNA, 1136 bp, Homo sapiens
tcgaaggcaagagattataagaaggaaggagataaaaatgatgcaagttgttttgaacttccttatgtgctagataatatggataacatgaaagatgccacatacattattccgtagtaaataggcattatcttaagtagtcattgtttttaagtaacctaccaggtcacatatctaagccccgtttttcactgattgacttaattctgtttttcctcgtaagatcttttacatgttgtaaaggtttgtttttttggttattgttttttaaatagccccacatggttatccatttatattatgattttgtaattcaggtttagtttatggttgtcctttatcacttgtttttgtcatgcttgtgtctgtgctcatcttgtatgtggtggcagaacgcaacagttgtcccttttgaattttacttttgttttgtaaaaacctaaaatgcaaagttcctttgttatgctttcttaattgtgttgacataaggttgtgggttttgttttcaagatttccttgatagctgccgtgccagtactctattggctgagctcgatgatgatgaggacttacctgagccagatgaagaagatgatgagaatgaagatgacaatcaggaggaccaagaatacgaggaggttatggtagagagagtaccccattctctttacaaagataggatgttaataattgaaatgaagaaaggaaaagctaagtcataatcaaactttgaagcaaggaaatgtggcaccagtataaaaaatgtagttaattaagaaaagcagttttaatctgagcatttatgattctccacttaaagaaaataagttgcttatatttgaaaaattttagaatgtcacatgatgttttaacaggcttaaaagggtgtgaaattaggctgggtatagggctcatgccctgtagtcccacactttgacatttgtagtcctggctacttgggaggctgaggtaaaaaatcacttgggtccaggagttgcaggctgcagtgagctataattgcatcactgcactccagcctgagccacagaatgacacaaacacacacacacgtacacacgtgtatgaacttagtgcagtggctcgtgctgccatgagctataattgcatcactgcac

SEQ ID NO: 9098 - DNA, 1194 bp, Homo sapiens
ggcagaggttgcagtaaaccgagatcactccactgcactctagcctgggcaacaggaacaagactcccatctcaaaaaaaaaaaaaaaaaaaaaaaaaggccgggtgtggtggctcacgcctgtaatcccagcactttgagaggccaagaagggtggatcacgaggtcaggagatcaagaccatcctggctaacaaggtgaaaccccgtctctactaaaaaatacaaaaaattagccgggcgtggtggtgggcgcctgtagtcccagctactcaggaggctgaggcaggagaatggcatgaacccgggaggtgaagcttgcagtgaaccgagatcgcgccactgcactccagcctgggcaacagagtgagactccgtctcagaaaaaaagaaaaaaaaaaagaatctttgatagaaaacagacatttgttcatagttctattatgtttatagttaataaatccaaatctcagttgttttagggtatatcattttttacaattctgagacagaaaccaagacgttttccagagtattttgatcgtttttgtgtagatacttacaaggagattacgatttcggttggaacgtgcacctggtgaaactgcattgattgacaggactggcagaatgttgaagatggaacctttggctacagttgaatctctggaacagtaccttttgaaaatggtgagtttctggcaagggcacggtgaaataagcattctgagctgtggtttagccttttaggacaataatttgggaagtatatatccagagttatggtaatacagtttggcccagtaattccattttagaactgatttctacatgaagatgtttattataattttgtaatattgaaatagtaaacaaaaaccttaattccaatcaataaattaatgttaaatagataattcatattaaaaatttaaatttaattgacaaatgtgtgtgataattatttctattaatttgagtatcatatagccataaaaatgtataaagactaatgataacagaaaaatgtttttgtacagtatgatcaagaatttgttttatcctatccattgaaataataaactaaagaaatactctgtgattattaatagtgaggtgctttggttgtgggactttttatttttctttatatttttaaatgagcatttgttttttgtttttgttgttgttgttg

SEQ ID NO: 9099 - DNA, 1235 bp, Homo sapiens
taagacagtatttataatcttatctgtaaatccttattgaattagcatactttagaaaataaaacttggcttttaatgactttttattgttcagatgttattttcagttgatatcatagattatcatgacaaaggtacacataataatagttaatatttttgagcttttattatccatctagattctttatatgtgttacctcatttaagctaacacaatgagatataggtaccattaatatccccattttacaaatgagggaactgaggccttaagcagtttaagtaacttcctcggattacacagttagcagtatatggagccacgattcaataggcagatcacatgcttaatcactttgctgcagttgcctttcttatagtgtcagtattgaaatgatcattactaaccctttttaggtggattttatctgtgggcattttcttcacattgttaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgtaagaatgtttttgaatctttgctttttaatcttcagaaaaagtgtttttgtataatgctaatatattaaacatctttcttcccattctctttctaggatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggaggtcagaaaatatttttttaaatataaaaagaaagttgtgagataaccatataggcagtttctagttttcggacagtactcttagaaatccagataacaaagtggcaccccttcgatattctcccct

SEQ ID NO: 9100 - DNA, 1435 bp, Homo sapiens
tgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatcattcttgtatttttaaattattttaccaacaaaagatggcaggttggtttctctcacatggattccagaaaatcagccttttttctcagaagagccctttctttggagcattatttgtgatggtttagattctctgtctcttcctaagtgtctctaggcattgagtgtatatttattgttccctttacctaaaatgtccttttctctcctgtcttctgtctggtgattgcccactccttttaggcctggcttaaatatcacctttccttggtaactctccttaacacttcttaacttcctcttacaccaatttaactgcttcctcatctgtgtttcc

SEQ ID NO: 9101 - DNA, 1155 bp, Homo sapiens
ttttggattttagagttgtagataaagggatagtgcatgttatacactgtgttgcttactttaacattctataatccatattaaatctatttgtgtacactttttatagagctttagtgatacatttgaatgaaaatatattcagtatttcagttaagagatggctacctgtagctgtatgttaagatggattattaggccataccaggcttagtgagaaagagtgccgtgatataatattatgattgtaaatgtgagaagtggcatcatatttaccagatatttgttatccctaatgcatctcattgaagatagtatttttgactctttctaccccagttttctgtgtgtagttacacagacaggccttcttgatatcacagtgcatttcaagtccagtatgctcaaaggtaagtctgcctcttcaggaagatataaaaattttatagcaccttttcagcagataaaagattttcctgtttttaaattaacctttaacaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtaaggagataaaatacttagataattcctagagtgacagtaacacattttcttttctttttttttgtttttgacagggtcttactttgtttcccaggctggagtgccatggtgcaattttggctcactgcaacctctgcctcctgggctcaggcgatcctcccacctcagcctcccaagtagcaaggactacaggcacacaccaccacgcctagctaatttttgtatcttttgtagagatggggttttgccttgttgccaggctgttctcaaacttctgtaatcccagcagttcgggaagctgaggcaggcagatcacttgaggtcctgagttcgagaccagcatggccaacatggtgaaaccccatttctactaaaaacacaaaagttagccaagtgttgtggtgagtgcctgtaatccctgcaactcg

SEQ ID NO: 9102 - DNA, 1220 bp, Homo sapiens
gtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaag

SEQ ID NO: 9103 - DNA, 2104 bp, Homo sapiens
taattagaggtaaaatgcacatttggtttaatagaggtttattttaaagtttgtgagacattatgttagattttgtattttgttaggtttgccttaaattttgaggtcatcttgtatttataacagtaaatcataaactgtttatgtagttacctcttaaaatacatgtatcattattattaatttgtatggtgctttgttgtaaacatctttattgtaattcagtgtatgtaatttgtgattaagatttgttctttttctcccctctctataggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaa

SEQ ID NO: 9104 - DNA, 2392 bp, Homo sapiens
cctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaaggtaaggttaacttaaggtcagtgatgtttataaaaatgcttgttgttacttttttaaaatactgacatcagtgttagaatttagtctcattcattccatacataataattagtagccctttttaattttctgagtattctgtggggataagtgattttttgttatttttgtgctttattggggtagagtttgatttcatattcttcagcataaaaattcttggtgaatgtgttttttctttttacagaaacccagatatgaagtgattttgttcttaatttttccatttgtaatcatcctatttttctgtttttcccttctgccctaccagttttgcggtattaatttgacatacctgtctcactcaaggatattaataatacaataaaattgtaacagtttacagtcttggatatttattaacttttccaggaagcttctttgcagatggtggtatactacctg

SEQ ID NO: 9105 - DNA, 1186 bp, Homo sapiens
cttgttgcccaggctggagtgcaatggcgcgatctcggctcaccacaacccccacctcccaggttcaagcgattctcctgcctcagcctcccaagtagctggaattacaggctttgtcactacgcctggctaattttgtatttttagtagagatggggtttctccatgttggtcctgctggtgtcgaactcccaacctcaggtgatccgcctgcctcagcctcccaaagtgctgcgattacaggcgtgagccactgcacctggcccaggaaaagttttttacatacgaattaaagatgcttctttatgcaaatttttaaaccccaggtttgaagtaggataaaaggtaacattaaatctgagatcatttctagctctggaattctgtgattgtaatgagttttgatttctaaatgttttttcctttcataatttcagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggca

SEQ ID NO: 9106 - DNA, 1603 bp, Homo sapiens
caccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttc

SEQ ID NO: 9107 - DNA, 1230 bp, Homo sapiens
ttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaatggtttgattaatatattccatc

SEQ ID NO: 9108 - DNA, 1593 bp, Homo sapiens
agatttagttttgaataaattaataataataagtttccttaactacaactcagattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatg

SEQ ID NO: 9109 - DNA, 1205 bp, Homo sapiens
agacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgt

SEQ ID NO: 9110 - DNA, 1212 bp, Homo sapiens
gaagctaggcacaaaaatcacactattccatttttatgaaatgtccagaataggtgaatccccatctctactaaaagtacaaaaattagccaggcttggtggcacacgcctgtagtcccagctactcaggaggctgaggcaggagaatcacttgaaccgggaggtggaggttgtagtgagccgagttcacaccaccgcactccagcctaagcaacagagtgagactccatctcaaaacaaaaaacaaaaaaaaaaaacatgtccagaataggcaaatctgtagtaggcagcaaattagcagtcgtctagggatatgggcacacatggggaaatggcaagtggctgttaatgggcatggggtttctttttgggtgatgaaagtgttctaaaatcgattatggtgatcctcagttctgtgagcttgctaaaaaccattgaattacatattttaaattgtgagttatgtggtacatggactatcaagctgttacttaaaaaaacggactgagccctttcccctggctggcagtgcacaggccgggccgcatgatgcctggagttactgtaaaagatgtgaaccagcaggagttcatcagagctctggcagccttcctcagaaagtctgggaagctgaaagtccccgaatgggtggacaccgtcaagctgctggccaagcacaaagagcttgctccctacgatgagaactggttgtacacgcgagctgcttccacagcgtggcacctgtacctctggggtggcgctggggttggctccatgaccaagatctatgggggatgtcagagaagtggcggcatgcctggccactttagccgaggctccaagaatgtggcccaccgggtcctccaagccctggaggggctaaaaatggtggaaaaggaccaagatgggggccgcaaactgacacgtcagggacagagagatctggacagaatcgctggacaggtggcagttgccaacaagaagcattagaacaaaccatgctgggttaataaattgcctcattcgttaaaaaaaaaaaaaaaacaggctgagtgcagtggctcacgcttgtaatccactttagcaggctgaaatagggggatcactttgaggccaggagtttgagacctgcctgggcaacatagtgaggccccgtctctacaaaaatctttaaatattagaataactttgggaggccgaggcgggtggatc

SEQ ID NO: 9111 - DNA, 1206 bp, Homo sapiens
ctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaa

SEQ ID NO: 9112 - DNA, 1212 bp, Homo sapiens
cctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataatctggaattctctaatttttacaatcagctttggacttttgctcgtgataaaaacagaccataggaaccaactttttgttgtacctgagtctctatagcagtaatttgctgctttttctgccgaaacccttgaggagtaagatccatttcatttcatcaaaaacagtaacatgatgtgcatggattctcattaaaaagaggagagaaagtttggaatacactcacctagttgagaatctggaaataattaattaaagtttttatgcatatatacacataaaaggagctatt

SEQ ID NO: 9113 - DNA, 1133 bp, Homo sapiens
aggttctgtctccaaatacagtcacattggaggttagggcttcaacatatgaacttggggttgtggagaggggatacagtttagttcataacacctaataacttggggtaactttgtatctcatatttttctaatggaaacttgaaatatgatgatgatgaaacattttattttaattacagggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcaggtaaattttcaatgaaaattgtttttactttttttccctccccctaatctctggtcattcaggattaagcgtttttgcaacctattagaaatacatttacaacaccttatctttgatttaggctgtccttttagtttgcaagttagagtttgggaatgtatttctgtatagaaataagattctctaaattccactggattgtatttgaattatgaggaacacatctatggtataacaaaatacatattctccctgatctccttattccttggtcagtagactctgaaacccaagaatagactctaaggctgccatcagttttggacagattatggtgagtgaggttactcatta

SEQ ID NO: 9114 - DNA, 1109 bp, Homo sapiens
caagcagagaccgccccaccctccgcggaacaagcctccggtctgcaaagccctaagccccgcccctctacggaggtctcacgtgcgcctggggatccctgccttcagtcacacctctatctctcatctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcggtaagtgtctgctttttcccgccccagactacggagggggagcgaggggcagccccagcgctgctcaggaggcgagagactccgggggaagtcggcctccgtggccaccggccatcgttaccgagactgagtttctgtggctctttatctcgtcttccatgagaagttttattaaagatgcgctgtgccccttttgagttgtcttccgatttacctgagccaaataagatgtaggcagttgcaggcctgagtcttcgttttgctttcctgagcaagaatttagatgaagctacttccccgaaaatccttttacttgtacgagacttttatttttcctatgtgtttgtagtgcttaacacaatgtcctgcgtgtagtagacgttcaataaacgaatatggaatatcagttgaatgccaatgatgatttaagatagactgatagctctctctgtaccatttgacgctgctg

SEQ ID NO: 9115 - DNA, 1134 bp, Homo sapiens
gagcaagactctgtctcaaaaaaaataaaaaataaatgcattttgacatagaagctaaatagaatactttatagtttagctttatttatgttattcaattgaaatattttctatcttagctgcaactaaagaattttattttcaagatacaattctaaatctgatgtcaaagtaaacatttttgtgtataggtgaaggtggtataatatctgggaattccttcaaaataatctgagggaagataagtgtgtgtatagattttttaaagattggtttataaattgataattgttaaagtaggttgataggtatatgggagtttattatactatcccacttttacgtgtgtttgaaaaaattttttttaaatcgttgtttttttcccccttttgccttctaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcctgttgttttcacctcctattttaaaatttatttttgacacctaatgtacatatttatggggtgcaatgtgatgtttcgatacatgtatacattataatgatcaaattagggtgattagcatatccatcacctgaaacacggtgtttttgtggtgagaacatttaaaatcctctcctctagctattttgaggtacacaataccttattagttttttgttttttaaaacaagatcttgctctattgcccaagctagagtgcagtgccatgattatggctcactgcagccttgaactcccttgttaagtaatcctctcacctcagcctccttagtagctggtactacaggtgtacaccattgtacccagctaattttattatttttttgtagagttggggtcttactatgttgcgtgggctggtctcagactcctggctagcattaagcgatccttctgcctcagtctcccaacatgctggggttacaggcatgagccacagt

SEQ ID NO: 9116 - DNA, 1214 bp, Homo sapiens
tgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccaggccacacgtgtctacacttagcctctatccatggctacctgggcatcgtggagcttttggtgtccttgggtgctgatgtcaatgctcaggttggtgcttcctgcccccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgaggtgagtctgtgaactccttcggcgctctaactaatgaggtgccattcccttcaccctcccaggcccctagagctgctccttatcagaggggtatctacataatgagtctctcaaatttctgtgcataaccagtatcccaagaatgtacctgccccccctctttttttaaagagaagcattaaaggcaaactctctcagcctgtaaagttcattatatttgggctatggagaatggagtccaagagttatttccagtagtggcctccccatcccggtagcttggcagagctccgctccggaagcttaacgtgtctt

SEQ ID NO: 9117 - DNA, 1258 bp, Homo sapiens
acgccattctcctgcctcagccttccaagtagctgggactacaggcgcccgccactacgcccggctaatttttttgtattttagtagagacgggatttcactgtgttagccaggttggtctcgatctcctgaccttgtgatccgcccgcctcggcctcccaaagtgctgggattacaggcgtgagccactgcgcccggccaatttacactcttaaatatagtttctgcccatagattttaactttttaaaaaagttgtggggaaatggcggcttcaggagagagcgggactttgggcggcggaggcggcacagaggaagcatttatgacctcctacagtgaggaataaagatggcatacagcatacctcatattcattccaaccctgacagtgacaccaagaatgttttcctgggactgcctggtgcttgttctcccgggccttgtcttcaggggaaacaaatagagaagggagacttggttctaacatccaaaaaccacattgaaagactgacccgtcctggttcctcttacttcaatttgaacccatttgagtttcttcagatagatcctgaagttacagatgaagaaataaaaaagaggtttcggcagttatccatcttggtgcatcctgacaaaaatgaagatgatgctgacagagcacaaaaggcttttgaaactgtggacaaagcttacaagttgctactgatcaggagcaaaagaagagggtcctggatgtaatttaggcaggaaaagaatacgtggaacacactgtgaaagagagaaaaaaaaaaaacaatcaaagaaggaaggaaaacctacgattgtagaggaggatgatcctgagctgttcaaacaagctgtatataaacagaaaatgaaactctttgctcagctggaaattaaaaggaaagagagagaagccaaagagatgcatgaaaggaaacggcaaagggaagaagagattgaagctcaagaaaaagccaaacgagaaagagagtggcagaaaaactttgaggaaggtcgagatggtcgtgtggacagctggcgaaacttccaagtcaatacaaaggggaagaaagagaagaaaaatcggaccttcctgagaccaccgaaagtaaaaatggagcagcatgagtgaccacccggggtcacaggcacagaaccttccccctgctatctcccttcctgcttcgaaggactcattctttcctcccacttccacctcaacatagagtagtatttgctttttagtctgt

SEQ ID NO: 9118 - DNA, 1159 bp, Homo sapiens
tttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatccatgagtgttgatttgtcttctatgtttcatatattttcaataagcagggctatatgagtagtgaggagatttaaagcatgaacctagattatcttagctaatcatcaaaaataaacttgaattcccttttcaagatacattccaacttatttctcacagatcctac

SEQ ID NO: 9119 - DNA, 1152 bp, Homo sapiens
tgaattctcttggccactaattcttaaaagtttgattggattagccattcctctactgttttaaaaaaactgtcagaaagatttatttttttctccacatcttaagggatttacagaatttctcatctgcaacttaatatattggcaaatattcatgttaagtgctaaaacatttttgaatagctaaaacaaagataaggttgttcctttcaaaatattttagagtggtgccatacccaggatgagaagttcctatttcagaattcttgctttgctgtaaatacataattcagaaagtttacctttttaatgattttatgatttaaacatttatgagcactgttggaaaggaattttctaaatggcaattttatttgttgtattccttttccctatctggggtaatatgccttctatgataaatttaaagatttagatggtgttgagacatcagtcactaaaacaaaacaaactttatatctgattatcaaaataatgttcattttagaaaacatggattatatggaaaagcatatgcaaaaatacacataatcctccaaaaccagtgataatttattgacaacttcagatgcttttactgccagttttttatgcttgtgtacatttaaaatataaaagcataattacagttattttgaattaaaaatcatttttttctcttagaatttgaaagaggcaaggaacctgtcactttaaaatagcaaaatccctcctttcctgattgcaaatgaagtcaggatttttcaagctgatacgtaaatttagaacactttccaggagatgcaaataggtgtgtagaggaaaagattaaagattcatagtgcaaatcaacataccaaaggcccttagaaaacctgttaaaaaaaaaaacaaaactgttggccaggcacagtggctcacacctgtacccccagcaactttgggaggctgaggcaggcagatcatgaggtcaggagtttgagaccatcctggctaacgcgatgaaaccccatctctactaaaaatacaaaaaaactagccaggcttggtggcaggcgcctgtagtcccagctgctcagtaggctgaggcaggagaatggcatgaacccaggaggtggagcttgcagtgagccgagatcgcccactgcactc

SEQ ID NO: 9120 - DNA, 1201 bp, Homo sapiens
tacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttctttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtgatttgtagtgtcttggattacttatgtgtatttagttctttttataacctatccacttgtaagaaagatttgaattggtttacgttaatagatatggagtaggctgggtgcagtggctcatacctgtaacctcagcactttctggggtatatttagatgttcaagacagctaagttatacttaattttaaaatatatgcatatgtgttgtactttgattaaaaggtactgtataagttaatgaaattctaaatagaaaatctttatttttttatttttattttttgagatggagtcttgctctgtcacccaggctggagtgcagtggcacgatcttggctcactgcaacatctgcctcccaggctcaagtgattctcctgcctcagcctcctgagtagctgggattacag

SEQ ID NO: 9121 - DNA, 1519 bp, Homo sapiens
atcacttgagcccaggaattcaagaccagcataggcaacatgaagagactccgtctctataaaaaaatagaaaaattagcctggtgtggtagtcccagctagtcaggaggctgaggtgggagtattggttgagcccaggaatttgaggctgcagtgagccataattgcaccactgcactccagcctgggcaacagagtgagaccctatttcaaaaaaaaaaaaaaaaaagaaaaaagaaaaccagagctaggtaatattaatagtaaaggtggtaaaagcagatgttacttaggaactaatgcaataggggaaaagaaacctcaatatagaagtgggttgggttcccatgagcataggcaaatgggactttacagctaaggagcagggagggggtcagtggatggaaagttactaacaggaatcatcagggttagagaagattgtggttaaaccaacttgacaggattcttgctgaagtcaggctacagtgatcaaagatggaggattctcagtaaactgacttagcagaattcttgctaaaactggatgatgcagagacagacacagaaacccaaaaggttgagggctagtatagtaaagggttcaaaggagcctcattaaagtttggtcaaggcaagatcctttttatttattttttatgtttttgagacaggattttgctttgtcacacaggctagagtacagtatactggtgtgatcactgttcactgcagcctcaacctgggatcaagtgatcctcccacctcagcctacagagtagctgggaccacaggcgtgtgccaccatgcctgcctaaaatttttttaatgttttgtaggaacgaggtctcactatattgcccagactggtctcgaactcctgggctcaaacagtccccctgcgttggcctcccaaagtgatggaattacaggtgtgaatcactgcatctgactatggcaaggatctctgtcactgaggtattaagtcttctgtatccctactgattttctgagcatgtattctgatgactgagagaggtgtgatgaaatttccgactataattatggatttgtctttctcttttcaccagtttttacctcaggtactttgatgctgttttgttaaatgcttacatatttagggttgcttatgtttagctagtaagttgaaacttttaatgtacttatttagtttgagtaatatctttgttttatattgtctgatatgaatatagccacccctgctttcttttgattagtatttgcatgcttttttcattgtgctctattatcctaaataagacatcgttaggaaagggtagtttttggaatgtttttactttgtgtgccttttgttattttaaataacattttgattttagaatgtatcattttatcaaatgtgacctaagatcctttaattttattttaaggtatgaggatataagtgttcgtcacataattagaaaaacttttgtattattacgttacattcttggagggaatctgaaaggtaatt

SEQ ID NO: 9122 - DNA, 1476 bp, Homo sapiens
tgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtttttctggctattttgaaatctagtaaaacctgagaagcctaatgtaaaattagagtatttaaaatcattagatttaaaagctactcatttaaaaaataacaactttaagatataattcacacatcatacacttcacccacttaaagtgcacaatttaatagttttgagtattttcgtgaagttatgtatgtaaccacatcaccacaatcaattttagagtattttttatcactcccaatagttactcatttttgttgtaaggctagtgtgtttttaaaaagggagatagaagttcatgtagttttttgttgttgttgttgtttgagacagagtcttgttctgttgcccaggctggagtgcagtggcacagtctcagctcactgcaacctccaccttctgggttcaagcgattctcctacctcagcctcccaagtagctgggattataggcgcctgccaccacacctggc

SEQ ID NO: 9123 - DNA, 1148 bp, Homo sapiens
gagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaag

SEQ ID NO: 9124 - DNA, 1525 bp, Homo sapiens
atacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgcatagagctttgcacagcaatctgtatccatgagccagttccaccactagtaccttcatctgtggcttatccagcaaaatgtttcatttcctgtgtgccctggcaggaaagaggttggtaaatagtgaattaaagggatgatcataaaatttaacctggttaaaaagcaccttatttgatgacagtttgtatgcactaaaatcctttatacaaattaagttttgtctactgatttgtacctggaaaatctgaacaatattcatgttgcttacagaaaaggctagtattggcttgaagc

SEQ ID NO: 9125 - DNA, 1137 bp, Homo sapiens
tcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcc

SEQ ID NO: 9126 - DNA, 1232 bp, Homo sapiens
aagattcaaaatatggattgtaaaaaaactcagtgagaaccaagaaaaattgaaaaccaacacaaagaaattagaaaatccaggatataaaaaagaatatatatataaatggattctggaactgaaaaatttactgaaggaagttcaaaatatagttgaaagttttaataatatagcccatcaaggagaagaaaaaatttcagagcttgaagattggttttttaatttatccagttacagaaaaataaagaagaatttcaaaaaatgaacaaagccttcaagaaacataggattttgtaaaatgaccaaattaagcttggtaagcaaaagtgagcaaactaagcatcataaatggagacataaagcctttctcagataaacaaactctaaggaaattcatcaacactagactggtcttacaagaaatgctcaggtgttctggagtggtgctgcttgggccggtggaggattgcaagctgctggtgttgtggctggggagagcggcgagagggtttggcattttttgtcgggatccccacaaggatgagtgctgccagagagtctcacctgcatggggtgaagtgttcagcctccccagatgatgatctgggatctagcaattgggaggcagcagacttgggtaatgaagagaaaaaacaaaagttcttgagacttatgggtgcaggaaagaaagaacatactggtcatcttgttataggagattgcaaatcaacgtctcacttccaaacaggggaagaagacaagaaaattaatgtagaactggagacccaatatcagcaaagtatggacagtaaattatcaggaagatatcggcgacattgtggacttggcttcagtgaggtagaagattatgatggagaaggtgatgtggctggagatgatgatgatgacgatgatgattcacctgatcctgaaagtctagatgattctgaaagtgattcagagccatagaaagaagaatctgctgaagaactccaagctgctgagcaccctgatgaagtggaggatcccaaaaacaaaaaagatgcaaaaaacaattataaaatgttgtttgttaaatccagtggttcataactcccaaacgcttagtctttgtattaaaagtaagccttattgttataatgcacagtggaggactgcctatagagcacagacctttgtattataatttttaaaaaggcccttttaaataattacaaagagtgtttgct

SEQ ID NO: 9127 - DNA, 1151 bp, Homo sapiens
agagcttaaactatttctttataatggcaaattacttttaactacttcctaaagtattataaacctgccagtggattttaagtgatagctaagcttccaagcttaattcacgttattacaaataaattatataactatcttaaatgtttatcttataattaaatgtaatttgaaatgctctaatgtattttgcagataaaacaactataaacaatattaggcaactggatgtttactagtgtcggactagcaatagaaatgcactttaaatatatatttaaggggaaatgcgtgcctggaaatacttcttttcctagtgaagttttatattgacacagagaaaagaatacttaaaattttgagtgatgtctactggcttccttgtaagtagtgattgatagcatgcggctttgacttgcaatacaaatcattacgattttatagttatcagaacattacgtttctttataaagaccctaaggtcactcttctttttgcaacttaagggaaaaaatattctcaagggaaaatactttttgaaatttatcaccattttagtgtttacatttcaataaatagttcacttcaggtttgggattgagattagttgcaatatatttagaagctcctacatgacagcacagatcactgccatctgctgaactgctaaagtgcttggtgccatgttgagaaaacttacccaagaatggataaatatgggtgaaacattactgagaatgcctcacgttagcaaatactatgaaaattcttgtttatatatcaaactgatttattttacaaaaaaaaaaaattcaccccaagatttatttagtttcccaagtgtatctgattaggatttaatttagagtaaacttttctggggacacctgattgcatgaactgaagtatacaataacacaaatattacagtaaacataaatggtgtcattaacaaaattattcctaatgcagatttattctttcaggaaatgcactttatttggaatactagtttatcatgaaacaatgacttacctacctcacagggttgttgtgaggattaagatgtttgttaaaatcttgactaccttgaacatgctaataaaaaaacatttttctacctcttttatttgcaggcaaggctcccagat

SEQ ID NO: 9128 - DNA, 1218 bp, Homo sapiens
tgaaggctcaaaagttttgttgggtacttttaattgagaagtagttttggttgctcttgattacacagtaaatcaataatcaaaaagaaaaaagagaaaaaaaaaaagtaaagactttgccaattgaattctgcactttttcccccaagactgagatgtactagttttatgttcataagtgtacatgtagacaaaacgtggctgctttttttttttttttttttttattttagctctccttccctgataaccatgattttctaggatgagcgatgctttaggtgctggagtgtattgaatgaatggacagagtgctgatactgcttcttggatgtaaatgcttcacatttttcatttgttttaaaacaaacaaagggctgctttttattttggtacttttaaaggttgtaaataacatgccaataggtagtcatctgaatactttcctgctaaatggttttagggctacggatgtaataaatttttaagacaattgcttttattatcatgatatttggggccctattttaggaaatcagatatttactgtttatgccttttgtatatgggcaggttaacgttggatgaatttaattacctatctatgctatggttagcatggataggagtttaagcatatcaggtgtttcagtttttcttcagtagtacagcaggcctcccagtgctgatgtaaatatttgagcagtgtttagtaccattcttagtgcatattaatttttttatatatccttataattttagttttttaagatctttgctttttcaaagtgttcagatataaaatggtgctaactgtaggatttataacaaggctataactgatgtccttttggatgttcagtatgagatatgcatgacatgttttgatagtcttttgcatttttaatggcttgattcatttgtgcttattaaaaatgttagtgattacgccaatgttaacatccaaaaatcatcagaatggcctgtgttatgcttttcatggttcctgaatagtgatttaaagaaagttacacttttgatcttctttcttcttgtgctagatattacatgtctttcttaaaaacagaaatatatgcattaaatataaagcactaggcagttatgcattactttgtacatttcttaggtaactgaatattttaaggttattgaggaaaactggaactcgatgtttacttgagtaatagttctaagttg

SEQ ID NO: 9129 - DNA, 1851 bp, Homo sapiens
tgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggct

SEQ ID NO: 9130 - DNA, 1189 bp, Homo sapiens
gccacgtgttctgactttcaggctttgtaagccattgtagccccgaaacagccataggcagtgtgtaaatatgcatggctgtttcccattattagttgctggatttagcccatgggtgattgttgccagtatctggttataaacgttattttggttgtttaaaccaaagcataaacatttaattactgtttctaggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagtatgcatttgtatttttaagagtatcttctattaaaaaaaccagtggtcagtgtattttcactgtggcaactgtgatgaaagatttggtctgtatgtaatagattttattactaaatgaggacaacagtccctctaaactgatgttgccatttaaaaatttttttcaaattgttttgaattaaaagttttagacattaagattattgggttaaaattgttgtagacattgtgatactttatattttccctttagaaattatcaacaaatttactgattactaagtagaacagaggacttgggagaatacttcataaacaaaagcataggcgttgcctatgttgtaagcacatttagaagtgagatgattttgcttctccatagagtactttttatattttttatatatcaattgaaaaaggcagtgtataggtaataggtaatttctcaagttttaggattttagttattgccaggtctgtttaagatacagatttatagcagtttgcttctagctgcagtttaagatgtttatctttttttttttgagtctgtcgcctaagctggagtgcagtggtgccatcttggctcacttcaacctctgcctcctgggttcaagtgattctccagcctcagcctcccgagtagctgggattacaggcatgcatcaccgcgtccggctgatttttgtatttttagtagacacagtttactatgttggtcag

SEQ ID NO: 9131 - DNA, 1189 bp, Homo sapiens; identical to SEQ ID NO: 9130

SEQ ID NO: 9132 - DNA, 1164 bp, Homo sapiens
aaatattaaaataatgggttgccactcccagcgcggtgaaaaagagacttggcattttgttttctcagcccagatagagatataagacaaattattccatctacacatttttgcttttcactttatattctgatttaaaagtacaaggaatgaggcacgttagacgctcaataacattaagttcccaaactggtggctattccattgtccccgggtatgtaatattttacaataaatctctattataacattttaagtgatttatcacgttagcaatgacgcccagccatctaatcattggaaacggaacttaaatttagagtttgttaaaacaaaacaccggaaccgcaccggggaccatatttagagtaacgccttaataatgcgcatgagtctccggcagggctgtgaaggtttccgggaagccagccaatcattcccaacggaaactcagtagcggcattttcaactggataaactggccttagtcccgccttctcgttccagagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacaggtatcttagactggactaattttgaagtaagagctgggaattcctgaccca

SEQ ID NO: 9133 - DNA, 1164 bp, Homo sapiens
acgccctccctcttaaaacattctctacttgcagcaagcccaaaactgatgaatagggttgctttattcaatcttcagagaatatctgcagcttgtcatagtattttgaagctattatgtgcgtataccccatgggtaactgaacatgatatttcctggcattcttcctgaaaaagatttctcagttgaagaatttgcctctcttcaaatatgccattttgtaggaattttctaaagacaatttggttgtagtcctagataagtgccagctttgatatttggaccacaccagaactttaaaatgtagcattccgatgaattgtcaaattgtttttctcttaatgttaccaaagcatgtttgcattctgaaaaagccagactatttatattttatagataacagtctgaagtttagaatgtagaatgtcacttttattttcagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggtaataattttgttaaacggtattttgtattgtaactgtactgttaaagagaattttggcgaatagttactagtgatggaagttattgacaatattattataaaaagcctttacgtctattatctcagaacagatggtgataaagaatatctgtactttctgtcatccattcaaatcagtgtcttcactgccttttgctgttattgttgttttctttttcttttcttctattttaagactaaccagataattagtgtcagatgtagatcatgagagcctagtcatggttgggacagtgatctaaaatagggtatgaaaggagttttgaaattaataaagattggtagtggatatgcggtgtctcttcttggcggctaggtaaaataatgacataatgtatgccacatacctaacacagtgccttccagttgagtactccaggaatataaaataagatgaagtagtgggatgtggttgcaaacatcattcatatctttgcactgaatgaagttgactttctgtttccctcttctcctaagggggattttg

SEQ ID NO: 9134 - DNA, 1147 bp, Homo sapiens
attgcccaggctggcctcgaactcctgagctcaagagattctcctgcctggaaataacctcttttatacttaaagcaaagctgaaagcaagagttcctagcccaagatggctagcagaaaggaagcagcagctgtgcagttggggcggggcccaattccttccctggccgccagggggagtctacccacagctgactctgctcaccttaagcgcgccacttggcgcaggcgctgaggcgccagacgtccctgcgtctctggttgggacgtcctgaaagagagtcgtcacatcctcctcaggactctatggttccggcctcaggactctatggttcccgcgagggacgaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactg

SEQ ID NO: 9135 - DNA, 1252 bp, Homo sapiens
tgctctgggttgcaatcctcaaacttgccccaaataaacattctacttatatgaattgtgcctcagttcttttttttttttgagacgtaattccgctgttgttgcccaggctggagtgcaatggtgcgatctcggctcacggcaacctccgcccctccccaccccgcccaagcgattctccttacaggtatgcaccaccaccacgccaggctaattttgtatttttagtagagacggggtttctccatgttggtcaggctggtctcgaactccggacctcaggtgatccgcccttctcggcctcccaaagtgctgggattacaagcatgagccaccgtgctcggccttgcctcagttctttaggtcgacaaattagtcctccagtaatttaaacgaagtgtttcaaaaaggtatgtacttgtatgtgcgtttattcatatggaaaaagagtacgtggtggatttatatattactcatttatgtgtacggttttcctgtatatacttgtatagcactttcacttttcggaatgtttaacgtctgctatcttattttaaatattttactacagttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaactttttgtggtttttacttataaatagaattccatgtttagtgtagtcccacctcaaactttactaacaagtttatatatgtatgaagggaaaatactactttactactttttgttttctggtcaatttcaaatgttgaatgaattcataaacattgagcagcttagaaggatctttaagattttgcaagagaaggaacaagataacgctaggcttgtgtatagcagg

SEQ ID NO: 9136 - DNA, 1920 bp, Homo sapiens
aggggttgcgaaaaagggaaaaaaaaaaaaaacaaaagcgaacagagcttccctgggacgttcagggagcgcggagggtgcgggaaggctggggcgggcggagggaattcgcagagcatctggcgggcaccgaggtctgggaacaggcctggaggcagctcggttcgtggagagagcgggctgcccgtgggccccaccctgtagggccccccagtagatctgctcccttggttcgggtgggcaggggagggcagagcgcaaaagagaaaagcagggaaggagacgctagaagagccacgggtaggcgcgagtcagagtccgaggttcgagggctctgggccggccgcatctgcgagccctccgaggcgccgtagccccgcccctccggcgcgtggcgcccatgacgctaggcgcgcgggccgctctccttacagaggtcgctcttgtccgaacggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggtaaccccttgggccgagctggaaaggcgggccacctcggtcttcgctcctttgtggagctctggcagtaactcccctccctctctgtttctctgcaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttttgttggcttt

SEQ ID NO: 9137 - DNA, 2726 bp, Homo sapiens
tccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggatttttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtgcagtttctcacgttatgttactcgcttgaactagataagtgggacgtgtggtgtgtcgggccatgttattctccagggtatatggtaaaaagtgacttaatttggaagttgcctgacttttgtaagaaaaaaaaatcaatttggttcttgtaaatgctggctgtttgaggtaatgcgccctgttttagttccaccaacttaatctgattgtatgataatttagaataccacagttaaacaatttttaaaatttgaggtcccatagcagtctttattctgctgttttttccaaattacaaccttagcatttttagaagtagagaattgtgtctaaagaattggccttaagtcttaaattcaggccttaattctttatagacttttggatttcaaagtttcttttagaggtcaaattgtttgtcctatcgaaatggcaaaactgtattcatttagaaagtaaaatagtatcatagag

SEQ ID NO: 9138 - DNA, 1477 bp, Homo sapiens
gtttctatcttaattataatatttgtaggaaataacaaaacaaactcaaagcctttattatttccagtctctttgtaactgatgtggtatggtatcatcatgaaatctaaacagtggtacactgagtggttgtcctgttcttcaatctctgtggctgagaactgaaataacttagaagagacagatttttatgagagcagttttagaatcctgacactgatgtatagaactccaatttaaaaaagttatttatctattatatctctgatctttagtcacactaaggctctcaaaatgttggccaagattggtaatgattcatacgtacttgatttttcagggctcctataaacttgtatagggatatttttccatttttgataaatatctaactttgaggcattcacttttgtaaaccgcgaaagtgccttacattcacctcatgagtattttaagttgatgcccagtgctgtggtatatcctgtatatatgtgttttgtggtatctatcgaaattattcttataatttagaaagttagaaaatagaaattgtaaatgaaaatgtggcgacctgactgcagaactttgagtactgaaccacatttaggtgaggcattttcatccattctctctgatttgctctctcaggattcatcttctactgtgtatgtcttctttcctcttagctctccaaagctgtatgatggatgggtgagaaggatgtgcattttggttgataggaaaaatgtttctgttttcttccttttcccctcacttcaagcattgatgattacattgattgagctacctcatccattaatttgaaaggctacacttcatcagctcatgtttaagaagtagcacatcccaggtaaacagagtaggccattattcaactcttaggatgagtatattaaaagcattcagatatcaatgacagaagaaacaagccctaatgtttctttataacagctgattcctgcaagaaatgcaaacacaggatatttttctgttccattacaagattactaagagatggaaaatattatcattctgtattttgtcagtagtacgattgcatacatactaagttgtaaacattgaattacaaaaaatgattgtcctaattgaagcagtcctcaatccatttgagtctgtacaataccctgaaaaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaagggactataaatcatgctgctataaagacacatgcacacgtatgtttattgtggcactattcacaatagtaaagacttggaaccaacccaaatgtccaacaacgatagactggattaagaaaatgtggcacatat

SEQ ID NO: 9139 - DNA, 1866 bp, Homo sapiens
aaacattaggaccaaaagtactagattgttcatctcttacattacttgaagcttcaaagcttcatcttttagtagaaactctagtatctaagaattttcccagcttttgcccttttggggttgagattcacatttcatgtttcacatgcaaagaatatctacatcattataaatatatattttatttagaatgattcagctagaaatattgatgtaacccaaagtctgtgttacttcctggcatgaatttcatctctaaggctactgctctaaaagtaattttgaaggcatagggtgatatagattcattttctacataattttctttctttaagtcagtaaattgaatttatttttaatgctcttggccaaattgaagtgacttttttctttatttgcagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctcaaaaaaaaaaaaaaaagaaaaatgtaaactaggtaacattttaattctaatatattcatttaatatgtaaatctatagatatctcttgatgtagatatttagaatcctttaaagttatttgtacaacagatgtttttattataacagtaatttacatttaactttaaagttagtgaagcatactaccataaatgcacaattatgaaaaattagaagctaaattacagattcattgatggagtcaattatgcaaagtggtcagtggttgttgaagcatgcattgcttcaacaggatttgcgtgcatttcccatgatcctgcattcttgtgttcttgatagcatacagacttactcagaatcaacagttgctgcttaatttgtctattttgtaagcttaggctactattttattaaaactggacatagatacttggctgaatacaaatagttttgcagattgcaatataataaaggaaacagtaaaaactagtgggctatgcttaggtttttcttgaaacctaacattgctttaggctgggtgccgtggctcgtgcctgtaatcccagtgctttgggaggctgaggtgggaggatcacttgagaccaggagtttgagaccaatttgggcaacacagtgagaccccatctctaaaaaaattttaaaaattaggcaggcatggtggtgcatacctgtaatctcagatacttgggaggttgaggtggtaggattgcttgagctcaggagtttgaggctgcagtaagctatgatcacggccactgcacaccagcctggtagcctgggtgaaagggggagaccctgtctcttaaaaaaaagggctggcctgtaa

SEQ ID NO: 9140 - DNA, 1704 bp, Homo sapiens
gctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatg

SEQ ID NO: 9141 - DNA, 2334 bp, Homo sapiens
ataataggcgccaccactgtgcccagttatttttaattaaaacttatggtttgtttagttataaataaagttgacattttaaaaaacagactagtttcttgctagaaatacatgtttatgtatgtgttgtgaacatatatatgattgtgttttaaaacagatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaactaagcgcgtggtttttgagtccatgttttagacatagtgctgtatttcatttttctgttcaaaaggccatagacaaaggaatcaatataattgaaaggggtaatgaaaaggggtattgaaaaatgaaagtgtggctagtggaattttatcactgggaaaagataatttgctgaacttgtgatcagacttttctaagatgtcagtatatatatcttatgaactcccacactcctctatcttaattgttctttcctgtcacttcttactttatatcgctacttaattatggtgtagccatttctgtgacagtctttagaagtttctctgttttggacctcctagataagtattacttttttcattaacacactttccttcttcctctaagaagtctgttcagtgaaactccactagagattttagtcat

SEQ ID NO: 9142 - DNA, 1143 bp, Homo sapiens
ctctgactcccatatgttctcttgagttggtaaaagttgaaaagttatctgcattggatagagatatttcaaacacaatactcactgctgcgtcactacatatcctaacccccattttcagcctacgggaggaaggaaacatcctttcttagaaactgtcaacctttctgatatgaatttacagctgatgactatttcttgtgggaatttactattctagttttaagcctttgtataaaggttaaaacttagttccagctttttcatatcctcctttgaacctgtttttgaaaagactaaataccagccagaagaaatatcttaaaaatacattacctttcaggtggtgtaagtcagtttggacagaaggcacactgaaaaatgcttaagtattatttgttctttataatttcttgtttagattttaagacctttatcctaaagaatgtcactcctttcttcttagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaagtaagtacatttacaacacaaatttgtttgaggagtgagtgaagggctgaatggagtctctgggctgctcgatccaagtagtgtgccatattttactcttaataatattcggcttctaagtaatacgtgacttgaataaaggatgtcatagtttataatgtgtgaaaatcattaattagaaatattagttcttcagacatttatagaatcttcatttctttgtgtgcgggcctctgctattagggatacaagtaagaaacttacattctcataggagaagattaatttgtaaataagtgatacagtacttgtgataaaagtaaggacctgggcttggcacagtggctcacacctgtaatcccagcacttcgggaggctgaggcaggaggatctcttaagtccaggagttcgagaccagtctaggcaacataacgagagccccatttccacagaaaaattttaaaaattagccaggctttttgcatggtctgtagtcccaagtacttgggaggctgaggtgggaggatagcttg

SEQ ID NO: 9143 - DNA, 1104 bp, Homo sapiens
aggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttt

SEQ ID NO: 9144 - DNA, 1117 bp, Homo sapiens
attcacaacattaatgctgattcattaatttcagttcagtttataaataggtgggtaattagaatgactttgataactaaaatggctcaaacaatttttatttttataatattcatggttttttttatcttatcttgaataactttccttttggacatccaaacatgataaatttatgccaaagcagttttggggcatatgagacattgtatcttgattttactctaaagcaaatctaatacatcaacaaaaatacatttttggtctttgtctttaagaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatt

SEQ ID NO: 9145 - DNA, 1132 bp, Homo sapiens
aatagatgtagggtacagtggaacataagcagtgttacccctggctgggagtcagtattatacaacaaatggtgagctggaacatgccctgtctgtgctgtccctcctgtgctgggtcgcggatgtgtaggcaacattgccttatcacgctaggttcacctgacactttaaaaggaaaaaaagttccatagagttctgtggtcacaaaattgttttgcttttatcaaatactttaatagaaccaaagttgcagatattggaatgtatggaagtatctcagtctctgcataagaggattaaagtatgaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacatatttaattactgtaaacaggtactgctttatgtttattttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatataaagctgttatttattctgcatttcttacatatctatcgcttgtcagtatacccgttttggtatatattgcctctgcacatctacatttgtatatgcaacagtgagctttatatctacataaactgtaaataatcctttctgtgaaaggatcatcatatcaagatgataccaaaagtatgtaaaaagaaacctgcattattttgtaattatttcttatagatatttcatggtaagattagcagtcaataaagttacttttttgcctttaaattgcctttttgattattagagctctcaagcgagaagcattaaggagtgacagtgttttcttcatgtt

SEQ ID NO: 9146 - DNA, 1161 bp, Homo sapiens
aaatgttaatgaaaagatatttgtgtcacatagtccagtaattgctttagcttaatcaaaaagatagttacattgtctttttacattttctatagcaaaaattaagcttgattgaatgaattgttttatgcttatacaggttaagcatccctaatccgagaatctgaaatcctaaatgctccaaaatccaaaactttttgagcactgacatgaggacacaagtagaaatttccacacataagcacttaacacaaactttatttcatgcacaaaattattaaaaatattatatgaaattaccttcaggctatgtgtataagttgtacattgaacataaaaatgaattttgtgtttagacttcagtcccatccccaaaatatcccattttatatatgcagataatccgaagtctgaaaaaatttaaaattggaaattattggcatttccagtaagggaaactcaacctgtaatcattttggctcagttaaatttggtaaatagcagtagtcattttaccttgagttgcagttgtacaaattatatttttgcctgtttttatagctgaaaaatacaaggatttagtacctgataattcaaaaactgctgacaatgcaactaaaaatgcagaaccattgatcaatttggatggtgagtatataaatgcataacattgaacatcaacatttttggttttttaaatgtttttttctttgaagaatgaagtccaggtttacttggttttagtaaatttagaaggatccatgcagacagcatttatgttaacattttattctctataatgtttttatgatgtgctttctccttccccttgcatttgaatatctgaatgttgatttgatttgcttctagtaatttggagttttgatttgtatttaatcatgggggtcattgtttgcctttttgaatgtgtaaatttcttttaatccaatgactctatcagacaagtggtaaaattttccattattttaagtcctggatatcttttagtaatttccctttttaaaaatatgaagaatctaattacctaaattatgatgtgtaaaatatttgttcactggctaattcattgtgacctataatttaggagttaacccttttgaatgagtgagcctcttggacactccagagctgctgcttaga

SEQ ID NO: 9147 - DNA, 1934 bp, Homo sapiens
aatcgaatggtattgctcacatatagcttaaaaagtagcaaagctattggataatgtctcaaaagggagcatattaatctaaatatgttctttagagaataagactacccttgataccatgagctatattacagggcttaagttggcttttgacactgtggacatattgtctgagggaccgaaaaatactatttagactagttctcaaatgaggaactgtggaacattaaagtctaagccctttacaccatgccctacaactctgatttgatagctcatcatgtgattctaacatgcagctagagatgagcaatggatttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtttactgatgagtatctcccagaacaacgatctcacctctacgggataactgcagtctacccctactgcccaacaggtaaaaagtatgctttaggatgctcctttaaattagcagggtagagaagggatatatatggtatttgattacccctgctgcctgtgacactgccaccattgccttcttcctgccctgagggccagtctttactaccttaaatctacctagtttatacacaaaatgcaaagacttgctgttgcaacttggttacaatatactcacccaccaccctgtcccacccctgctcttctctcacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgacttaaggatctatattgtctctaggacaaagctgggggttggcatatatgccttaaccacaaaggagaaaggtgatttatgcaaacatacagtacataataaaaattctactttcctaaactttattaaagaaaaaagcaataagcaatggtggtaaatctctagaacatacccaattttctgggcttcctcccccgagaatgtgacattttgatttccaaacatgccagaagtgtatggttcccaactgtactaagtaggtgagaagctgaagtcctcaagtgttcatcttccaacttttcccagtctgtggtctgtctttggatcagcaataattgcctgaacagctactatggcttcgttgatttttgtctgtagctctctgagctcctctatgtgcagcaa

SEQ ID NO: 9148 - DNA, 1835 bp, Homo sapiens
aaattttattaaggctctgggaaaagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatatgaggcaggtacactattggcctcattttgcaaatgagacaaacgcatagaggttaaatgcccaaagccacatggctactaagtggctgagcctagatttcacccgagtgcccacatgtccagctactctgctctgttgcctgcaggatcacagtgcagtgttgctcactgcagctgtgcatgagcaaggcagctgagtgtgaacaaaggggaaatgtaacctaattcttctaattctatgatttgatgcacaaagggctccataatcgtgggaattgattacgactgccgggagaggatggtgtactggacagatgttgctggacggacaatcagccgtgctggtctggaactgggagcagagcctgagacgatcgtgaattcaggtcagcagcttcactcagcagtctgcatttcatttgattctacaaagtcacttgtctactttacgccgaagtctcccctcgatttttctccattaggggaggttaagttctaggcaagtcattttattgagctgtataagactagccccctctgtaagcaaacaccttcatacatacggaatgaaataggtgattcctactgtgcgcacttcttaaaagaattcatggtaagaattcagggtgacgccttcgtttattcagcctggctctggcactgtggatgccggttgtcatcaaactggtaggtctgctggtctagaagctagaggtagtggaatatgtaacaaaagtacttgtttctctattaacctggttcttggggacttggagacacttgggctttgctttcccctgctgacccccctgcccacccgaccgttggagggcttcaggtttgccctccatatcctgcaaacactccagtcctgactttgctttatttccaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgagggtcagctgggcttccctaattcttctcttacctgtagatcctgatgtgaagcccttgggttttaaatacaatgtggggaaggtcagaacaagagagtgaaagctcaaatgcattcatgtaacaaagatttactgaggatctaagaggtgtcaggacctgttctaggaaaagacaaggtctgttctttcatggcacttatattttattaggaggaaacaagactggtataaacaatattagtctgtgatgtgatatgtagaaaattcagatagtgttgtgagaactagggctactctgaatcaaatgatcaggcgaggcctcagctgacacttaaactggaagtgaagtgggattcctccagcagcacatttagaaaccagggttgacgctcacagtagggctgacctacatcaagtgacattagccaaagctcagacacctctggcttcagtgttgctgtagcagaaatcaagataaacattttccctgtctgtataattgctaaggtcatcaaatgtgacatacagga

SEQ ID NO: 9149 - DNA, 1145 bp, Homo sapiens
tatgtgctatgttgatttataatctggtccacacaagatcccaatttgcgtttggtgtctggtttttgtcattagcagcttccataattggaacatctgcaactcggttcagcaggcagttactccccctccccagcccagggtgacaggggacacgtgtcactctggagtcctaaaaggaagctgacacaatgctggctctgttttttttttctcttgaaaaaaaaatctgttctgctttgttctgagggaagtgttttgctgtcttcttccctagtaaatggcagatttacataattgatccttaaaaaaaccctagaaattagaatttcttttgaagaacatctggagcacatctgcgtagggcgaagaacttttgatatttttggaggctctggtatgtggtaaagtaacttttcttcccatctccctgcctgcccttgttccccttcctgctctcccaccctctctcccacaggtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagtggatttctcctgtagggggcagggctgcgtggctttcccagtgggagccacctcacaggccctgttgcagtgaggtggactggtgcagggaagtcctggagggtttctgagctgcagcccatcggcatgggcccgatgccaccaccataggaccagggctctctcttgctgggagtcacctgtcactgaccaaggctgtgctctctggttcgttcatggagtttcagataatatggaaagggaactttagagttgtcagcacatggaggctgtatggtgatccaagggaaaatggaccgactcttaccctaagtccccagggttgtatgtcataacatctccatggaaatcctggaaatcaaagtgacaggacaactagtcacaaggtgtgatctctgcggtttgttggggactccaagtggaagtcagttaatgactgtctcaccgttgcagcccttccctttcactttggttctgtccctttgaccca

SEQ ID NO: 9150 - DNA, 1166 bp, Homo sapiens
gatgagagtaaagaaaatgcactctttagccaggcatggtggctcacgcctgtaatcccagctactcaggaggctgaggcaggagaatcacttgaaccagggagttggaggttgcagtgagccgagatcacgccactgtactccagcctggcgacagagtgagactccatctcaaaaaaaaaaaaaaaagaaagaaaatgcactctttaattcagtgggatgagggtaaaagtgacaggagaaactgcgtgtgtgtgtgtgtgtgtgtgtgtgtgtgtgtgtagcaattgctctggagtgttataaactttaattgaggactgcttaggtgatgggtttttgtgcttagtattttaacagcaaattcataccagtacttgaactttaatagcatacaaaccatctaggaatcttattaaaatccagattctgaatcactggaccttgggtagggtctgagaacctgcattccctggtctgttgctgttggtctgtggatcatgccatgaggagtgaggctcatcctttgcaggcctaaactctggatgcccttatcttcttctcttttcagtgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactggtgagtaactgcaggtcagcctcaatgactggaaagttgctttggatgcacatccccacatagatggagctctcccagaaaagacaaaggacttcctttgactctaacagccttgtggctgccaaaatagtgagaaaaaagcgtcctttgagttagaaaggggagccaagggtgatttcctctggactagatgggcgagcatatatggcttccttggcggagacgttcctgtagcactcgggagcttctaaccttggttccttggagccagcgcaggctggaggaatttagggaaagttgcataccttcctgttaggcggtctccaccttaattcaacacttatggttgtgctcttctgctttaagtgatattttaagcaatctctaaacacatatgtaatttctaatttttctcctctttcaaaagagagaactccacatatataaaaag

SEQ ID NO: 9151 - DNA, 1066 bp, Homo sapiens
tggattttgcaccggggctgtgaaaagaaaacatctgttgcagttcctggatgttttgagttaagttttgtaattttgagcttttgtagtaagtagttcttagacttaccaaaaagcacattttctgattttctttaaattttagacagacattgtgtgtcttatatccccaaaaggcaacggtagaaatttcttgatattaaaaaaaattgttggttttcttccaagtatccattctttttaaaacagttaaagaattcttagaatattcacttaaaaatttatcttcctgtggtgtttacttgaatggcatgaaatttttactatttctgattatctgcaacatgcattcatatctgatttttaaaaattctacatctgccaaccatttgtcccattgaagcatcatactagtgagaaaacattgagtttttagaccctccacttctgggacccttgaattaagcagaatttttctcttctcatttcttcttagatgaaaatgaatgtgcaactggctttcatcgctgtggccccaactctgtatgtatcaacttgcctggaagctacaggtgtgagtgccggagtggttatgagtttgcagatgaccggcatacttgcatctgtgagttccaaaatcattttcctgtgtggccaaaatggtgctctttaatcttgctctttaatctgtcagtgttttgacttctgctattcagaggctctgctatatggttttcttaagaagacagtttacatcaaaataacccaaagctggctggatgtggtggctcacgcctgtaatcatcgctttggaaggctgaggcaggtggatcgcttgagttcagaagttcgagaccagcctgggcaacatagcaaaaccccgtctctacaaacaatacaaaacattagccaggtgtggtggcacacgcctgtagtcccagctactcaggaggctgagataggaggattgcttgagcgcaggaggcagaggttgcagtgaactgacagcatgctagtgcattccagcctaggtaatagagtgagactctgtctcaaaaaaacaaaa

SEQ ID NO: 9152 - DNA, 1166 bp, Homo sapiens
tttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtatgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattcaagatttggtgtggtttttggtgggtcatgaaaggggtctattcggggaaaaaaaggaacttctttcatgggaaaaggcagcatcatt

SEQ ID NO: 9153 - DNA, 1755 bp, Homo sapiens
accttgaacttctgggctcaagcagttctcctacctcgggtttccaagtagctacgactacatggcacacacagccatgcctggcaatttttaatttttttttgtagagaccaggtctccctgtgttgtccaggctgttctccaattcctggcctcaagtagttctcccgtcttggcctcaaaaaatactgggattacaggagtgaatcactgcacctggcatatgtatttaaatacttttaaaataactaatttctagacattaatatcttagttttaccttgtcgaattaagaactaaaatatattaaaatacattaaatggtttatgcaccttaaatttattgaaataaattactttaaaaatgttttaaaatgcaaagtgaataacttttacagataaaatttatctaagatggtttctgagtgaaatattttttggttacagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgact

SEQ ID NO: 9154 - DNA, 1314 bp, Homo sapiens
ctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaatatttatttttgtacttgtttttaatgtttacatagtattaatttagtagaaatgaacttctgccttttggaattgctttgcctgcatgttattttgtgagaacaactggttagtattccacagcgttgccagatagagatactttatctcaaagatagtctttcacctcaattgaaaagccctcattttcttaatacttaaaaatgaatgtgtaatatctaaatgttagaaatgtacttataaatagaagttggctgtggcagaatttgttttaaataacaaaattattcttggtttacaaaaaaaaatacatttacgaatttactcccagtcattactgctgtcatcattcaagactcagatttctagtcctttaccctttgcatgtaattagaccaattcctgttgattttcccctcacacagccttgcatcttttctcttgtcattgctgtcaccgtcatccaaattcagttctttgtcctgtgcctgctgt

SEQ ID NO: 9155 - DNA, 1203 bp, Homo sapiens
ctgagattacaggcgtgagctaccacacctggcctgaatacagttgttttcattccagcttcccaagtatatgtgtatgttaccttctgcagcagatgccttcataaaatactatggcaaaatccaacatgttaagatgccacagaatgagggctgcttgtattgacttgagatttcttaaaagtaaatttagccattttaataaaaattttttgttacaggatgtgaagttaccccagatgtaaacatttcaggccaaaaatttaacattaaactcctgattccagttgcagaaggcatgaatgaaatctggcttcgttgtgacaatgtaagttttccagttaaaaatacacttcaattttcttaaatgagttgaccagtcatccttatattttatacttgaaagacccacctcgtgatacattgcacacatcagtatttcttttctccaggaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcaggtacttacttcattttacttcatctactgtgctggtttgtttttataattttgtacataactttgtttttcccctcttaaacaaaactttttagtcttaattttgtatcagatggttagaatataaaatacagttagagtatccctaatctgaacctctgaaatcctccaaaatctgaaactttttgagtgccaacatgactctcaaatgctcattggcacattttggatttcagatttgggatcctcaactggtaagtataatgcagatattccaaaatccaaaaaaatctgaaacccaaaatacttctggtcccaagaattttggataatggatactcaatctgtagaaaataaagtaacctttagtcagtttaaattggtcattaaaaaaaaaaatctttatcattttaatagaacagataaggacacagaatagttgagaacttactctaaacaaattgcagaaatcattctgttaacatggtgttctttcagacattttagggaattgaatatggtctcaatgc

SEQ ID NO: 9156 - DNA, 1181 bp, Homo sapiens
agccacaatggattcaagttcgaaatacagcaacttcgaaagatgttaccaagcgactaaagtccatcaaaaacatccagaaaattaccaagtctatgcaaatggtagcagcagcaaaatacgcccaagctgagagagagctgaaaccagcttgaatatatggattgggatctttggctctggagaaaaagctggtatcaaggtgcctgaagacaacaagaaacacctccttattggtgtgtcctcagatcgaggactgtgtggcgctattcattcctccattgctaaacagatgaaaagcgaggttgctacactaacagcagctgggaaagaagttatgcttgttggaattggtgacaaaatcaggggcgtactttacaggatgcattctgaccagtttctggtggcattaaaagaagtgagaagaaatccccctgcttttggaaatgtgtcagtcattgcccttgaattactaaattctggatatgaatttgatgaaggctccatcatctttaatcagttcaagtctgtcatctcgtataagactgaagaaaagcccatctttttccttaataccattgcaagtgccgagagcatgagtatctactataatattgatgctgaggtgctgcaaaattaccaggaatacagtctggccaacagcatctactactctctgaaggagtccaccactagtgagcagagtgccaggatgacagccatggacaacaccagcaagaatgcctctgagatgattgacaaattgacattgacattcaactgtacccgccaagctgtcatcacaaaagagttgactgaaattatctttggtgctgtagctctggattaatgaaaatcaagttccatcctcagacaaggggtaaagaaggaaaattcagccagctgattttgtttttagcttactgttgtctttgtcagaagaaagtgttcctccattgttttaattactgaagacagcaagataagtgtaaattattttacaataaacaacttaaaatcataaatatcacttatcttcatgcactcgtatgcaagttgaaaggcagtatttatatggtacattttgtctacagatgtggagactttaaaaataataaaatcccaatttgctgaagaaacagacacaagcatgatgtgtcatgtgatgagtctcaggtgaa

SEQ ID NO: 9157 - DNA, 1413 bp, Homo sapiens
ctaagctctgatccgccattaagctttcagctgtgccgttctacttgctaaaattggaagggaataggggacaactacagcatatgcactgagccaagtcatatgttaggcaaaagtccataaatgcaaattaaaatcactgtgaacttgtcattagtcttgtcattttctgtgatactagtttgctatataaagcatactctctcatgctctgagtttttttttaataattagtaatgttcaaattaacatcttttttcttcttttcagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcactttcagtgcattgtttgagattaaaaatagtatttcttaaacttgcttaatccatgataaagacatgttgctgtcatttttaaaaagtgacgtactacattatgggttttctgaaaaataccatgcctagatctaaaaaggaaaatttttaaatgccgagcacattaacctcttttgtcatttgacaagattcataaacgtggatggcatagcatcatcatttctctt

SEQ ID NO: 9158 - DNA, 3792 bp, Homo sapiens
ttttttttttaaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaagacttccagcttttctttttttactcacctctttccccctttggagttactggtatgtacctggctagatttgtgtgagccataaactttatctggacaaactga

SEQ ID NO: 9159 - DNA, 1175 bp, Homo sapiens
catgctcattatgcataaaagcatgtgctaattgtgtagtttgtgatattgctaatttaactaccttgtttaaaagcattagtgaagtccagtgtaataagtggtataagttggggtcatatactgagtaagaagtgagtcaactttgtaacttgcttctaagttgcttgactagtacttaaaacctgaaaccctacaatttaaatatctggtttgtcaaattaagtaactagagtaaaaagaattcaattcttttttctgaaatcagacattgtttctttccgctaagatactggcttatgtcattcagtatttcctgacagctgggacataagcatagaatctgtgcctcccagccccatatttacttaataaatggaatgaaaccaagtgggcagaaggaggctttgattggattgagaatttagtaacctgagtttatgtataatttagtaagataaaattttattttgtagcatgtggtaataaatttataactgttagtagaatgggtgcttggtgtatctcttaaggacttatgggtaagaaaatgtttaaaagttgcttttctctgtggtgccagggcatttcaccagatgaacttaaagatgaactacctgaacgacaacctcgatatccttttcttagtgctttaaaagatttattttctttagtggtcagacctgtttgtgagctcatttgttaaacatctaaaagtatccttctgtgtcatgatgacagccaaattaaaatatgtgtgcatatactagactaagaaaaatgaaaagttggtttattcgtgggatgaataattttctttttaaaactatttcctttattataacgtgtacaataaaaattgagaaaataatctgtattaaacttgtactttaaaaagttaaattttttgagagattatgtgattttataacttatccttggaacccatttaattttgtggaaagataataatgaaggtgtggcctaaaagaataggacagaaacttgcagctcagtagctccccaggtgttggtaaatacctgtctgagagcagtaactttagtttctttaacttgagaaaaaccttcattgtgtatagttataaatatcaacatgatgatggaagagtttcatatcctctgtgctttattttctccagtcctgttggtaagtg

SEQ ID NO: 9160 - DNA, 2070 bp, Homo sapiens
gtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggtttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgtttttgatctacaagatccaaataattatccctatcttcagaattaacttagtctgtaatgtggcttcaaaaaaagaaagccttttgacagctacatgacttacaccatacagaacagtactggacaaaaggggtgatattttaaatttactatcccagaaacagggcaacgtttttagaaacatctttagcccaaagtaactagtaaaaataaatggagtggtatcctatcttctttttttaaggaatcaatgaataataaatgtagatagacaattttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagtgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgttttctctggcttttttattttttcaacttcaaggtattaacagctgttaacacttaaaaagtactgccacatatgtagccttgaagtagttgatctaataaatgagagcagggaggagattcattgactctgaaatgatttttatttttcctttggtatttgctacagtgaaaagaagtttggaaagtagata

SEQ ID NO: 9161 - DNA, 1164 bp, Homo sapiens
agctcacaccggtttctctccatcctcagcttgcgcgccaccatcgccgtcgtgctggggccgctctccaccgctgcgcggtgactgcaaccgcccgggccggccctcgaggcctcctgcattccgccccaacccccggccccgccgcggctatccagtcagttcactgctattcccatgggtcacgagacagatgaggagtttgatgctctctgagtaacatacttcaacaagccagatatagatgcctggcaattgcgtaaagggatgaacacacttgttagctatgatccggttccagagcccaaaattgttgatgctgctttgcgggcatgcagacggttaaacgattttgctagtgcagttggcatcctagaggctgttaaggacaaagcaggacctcataaggaaatctacccctatgtcatacaggaactcagaccaactttaaatgaactgggaatctccactccggaggatctgggccttgacaaggtgtaaaccccatggatgggctttgcaaggatttattgatattgctacttgtgtgtaaacagttacctggaaatactgatgataatatataccttatttgaacaagttttcctttattgagtaccaacccatgtaatggtaacctggactttaataaaagggaaatgagtttgaactgaaaaaaaaaaagtagctctccacaaaatacctattaataacttttaacctagtaagtacaaaatacttattaattaattttacagtgaagaaattcagcagacaccatcttaaccaagtgataaaagtcaaccctgatagaaatagaacaaattacgttgttgccttctgatgctgcactgagaagaacatagcatcacttctgtggtacgcctccataaaaacccactaccaacaaataacctgaatctaaccatgagaaacttaaggcaaactcaagcgtagggacagtctacaaattaattgcctgttctcttttaaacggtcaacatgaaagacatggaaaaactgaggaatctccaagttgaaggaggttaagaagacataacaattaaattcaacacatgatcttctattggttcctgggtcagaaaggaaagggtgattataaagcacattatggagacaatcagtgaaatttgaatctagtct

SEQ ID NO: 9162 - DNA, 1104 bp, Homo sapiens
ttttctgtaaaaaaaaaaaaaaagtactacacaccatataaactggtagctgtttgttattcttgatatgtgcagtaaaaactatcatgagagagttggtaaagatttaatgaactggtagaacatgtttttcttagttgctaagaaccatctgagcttaaatttaaaaacatttttttctaaaaacaaaattggtttctgaatcaaatgtgtatttctttcctataggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctga

SEQ ID NO: 9163 - DNA, 1553 bp, Homo sapiens
gcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgttttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaacccaagttttgcaaagattttttctcctgttttgatacaatgttgaa

SEQ ID NO: 9164 - DNA, 1140 bp, Homo sapiens
ttgttcaaaaacccattcaaatgattgctttattaccttttttcttaataaaacagtaaattgagactctttcttccagattctaaatgaccaaaacaaagcattaaaatcagaagttcagaagctacagactcttgtttctgaacaggtaaggcttttcctaaattacaaagtagaaatacttgttatataacaagatctggttcttcttatttaggtaccaaattactaattgagaaattttgcttaagcttagatatggctgttattgcctttctattcatcctgtatctaaattcaggaaattttttctccctgaggtgaagctaatgccaatctgctcaaaagcacattccagaaaaataaaaatgtgtaataggatgcataaaaataatttaagccattttgatacatttgactttcagaataaatgtcctgccttagacttggagcctcagctttttcttttagggagcatggtgtctttaaaggttgaaacttattactagcacttaaaagcagtgtgatgttgatcaaatagcttaacctttgtgacacctctcattccaagcctttcacatggagattatattatatttacaccataaagttgttagatttgaaaggagaagcttatgtatggtgcctagtctagtgctttgtttatgacaggtatctaaaccttaattcttttcccttagagtatttattttatccatctcatctccatcccctgccaccatcactattcattttatatttatagcaagacatcaaaactatatcagctttgaataagcatggttccataaattagagcccagtggtatctgttctctgcctattcctcagtgctgccttcgtactcttcttctacgcagctcttacaattacaatttattaataaaacacaaactcttgatgacacattagaataggaagtttgcgtttgttcctaatattaagtttttgaattgtacttttattggaagccgaaatgtaaagccattgcaaatgatagcacttctttagcaaatgcatgcgttctttcatttattttaaaattcacatttatgcagatattgagctggtgtaagtagctgtgcctctggaagtattttgttaacttgtcaagaaata

SEQ ID NO: 9165 - DNA, 1404 bp, Homo sapiens
cttagaaaacttcatatgacctaaaaaaaaaaaaaaaaatctatttctgctcttttaaattatttattcactggggtaaggttgtattcaaccccttttcagtgctactcactcactttagctttacattctcttgagtaggactaataaaaatggattaccagtgttgttgttttaaatgttttctaacagaatttggctcacatttaaaagtatctacctaaaagcttgtttcctttgaatcctgagatttttctcagtttgattaccattagtgtgaattgctttgagtctatttgaaagggccatgctagatcaaatggaatatgtacttttggtgtttgacaaatgtcttctgattgccttctgttgctttgttttaaagtgaaattcattctttctgatcttttacagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgacttgttctaatttttattgagctttaacagatttcattagtagtacagatcattgtaatttagaatacagctattaattggcaaccattcaacaagataggtttatgtagcctctgtaacctttctaactgatgctctgggtcctcttcagtttggtccaatgtaaagtgccccaggagtgctggggtttcagaaaggacagagcaagcatttaggatttcagactaaacacccacacttcaggtagaggagctctatttttaccattactatttttttttgaagtaataataattaactgttagttttctttttcaggcacggttacacagtttacatgtgttatcttttttgttgttgttgttgttgttactgtttttttgatacagagtctcactctgttgtccacgcaggagtgcattggcactatctgggcttactgcaacctccacctcccggttcaagcaattctcatgtagctgggattacaggcgcctgccgcca

SEQ ID NO: 9166 - DNA, 1214 bp, Homo sapiens
gtgctagctggtagacaaactcaagttctaatcataactctgacacctatgagtcagttatatgacgttgggcaaaataaaatctttctctagccttattctcatcagtaaaacgaggataattgctctttgtcctcatcgcaggccttttgggtttgtttgcttgtttaagaatcaaatacatgatttcagggggaaaaacggctttgcaaactgttaagtgctatagaaacacgaacatattgaacatacatttattaaatccctcttactcatctaccaccgctattactaataaatatgaccatttactcgcttgaaacccatgctggaatttgacatgcaaatatcctgagtgttgctcatttgcattggaaaaagggaaagaggtgggaggccttttgaagccttttaaaaattgagctagggggatgaattcttatcactgggcccaagatataattgattttctacacaatggctcacaggtgctacatttaacaccctgagtagtaggaggatggaaacgtatcccaaggtgcagctattacttaaaatatctacaaaatcagccgcttcactctggggaaggcagagaagccttggcggtgggaggacctggtggggggactccacccagttggcggatgtgctgacagaggcacctgctccttgcttatcccactcggagaactgggccttggcttccatggccagaagccaaaaagcacctctttttcagacctggatcacaagggccgggaagaacacagggcaaacccaccatgaaatacatattaatattataacaaccctttcagaattcactgttgctatgtcaacaaagcagctggggaaattgggtctttgggaaattgggaaatgaggtcagctttggcaacctggcaaatgtttccttctctcagaacaattgctctgtgacaccagtcagccttttcctacctaccctttcttctgcttatttctatgaaaattgagaagcaaaacaacagccattaaggtttgggattagggaatttctgtgtcatggaagaagaaagagaaacaaaatgatttttctctccccaccaaccttaacccttttcacctgtttatgcccttttctcagttccaacctggactccaccagactgaaatggattctgtagccatctctgtgattttagttgaattactgacttcatctcagtttc

SEQ ID NO: 9167 - DNA, 2714 bp, Homo sapiens
gcatataaatttaggatttgaaatatgattttttaattaaggtcagtcctactcataaactcattttctgcaaagcattatcatggcataaggttctatgttcaaaattatcccaagtaacaaagaaaaaaagaataactgcctgaccaggattttaacttgttattctagcttaatcatagataatcagcagtgaaaactttccttttgaaagaagaaaatatcattccctataagttatttgatctctcttaaactcaaagcttaacatttcacttatgttgataagttaatggtaatggagccatttggaatcttgattgtataaatgtttaccaaatacactaaggtaagcaagaggcatttatctagtgagtaggcaaagatttaatataataatcccctaggcaaaagtttataagcagttagaaaaatcagtgaatcttctatttgacatttctagaaaccggaggaaaatctagggtgtcctggaaaagtgatgaggtgttggggaacctgatgccatctgttgccattccattctaacatagtgctacagaactgaaccaacttaggttttcatcccattgagatcagctgggcacactgtgatgcttttgattttgtctagaaacctgtcacttcaggataatttctgaagacaaagtctgtttcccgtttggtaggtgacctgtttaatgttttccctgtgtctgggaactccttagtgtaattagcgacctttgaactccacaactaatcctgagctattttgtattccttactcatctttaaggctggacctttcctttcttcagagtccgttgccacaattaaagaagaaacagctgcatttcaaagggattccgattccagaagcttaatcgtgattgacatgttcttattctaagctataagacactctaagagtcctttcttgggttaaaacttcaatcattttctaaaaaattatctcactatggattttattcattttctttgataactattctttgcattttttaacttgaaagatgctttgcgtttgcagtgaatatgagcaactacttccagtgaaagatttggatagtgtcagaccttctctagatgcaaaattgctaaattcccttttagtgccaaaatatgattatgaaatctgatgtctatcacataggtaattattcttcaataaactcgaaaggttaaaaaaaaaagtgttaattttttagaatgaactccagaaaagatcgttcatgattttgtaaacgcttcttttctccattttttactaaacaatattttaaaaactttttagagccagcaatatagtacttaggcaatacccttacggtggtggcaatttttttttaactttttaagtaattgattcaaatgtcaagtttgaagcagtcttgtcaggaattctgatgacaattatttgtttaaaaaattttttttattaaacattagtctgtcccataaaatcgttttcatttttttcacaccaattcagtatttctactaggttaaaattatggtgtttttatacattgtatgatttaagatctttcaaggcagacatttatacttggtaacaattgccaatttttttttctggtttttgttgtagtatttcaaaatacttcgtagacattgatagactcctacactacccctgggagctaggtaggtggaattatcatccaggccttctgtagggactgctgccacaacagagtggttgttcctaagacaaaggtcaaaaaaaggggtgttaataaacagtcctcaggtttaagggacttttttaggattacatcttaaattccaacaaatcagatttaggagttactgaaagtgaaattgatccatccctcatccaaactttgcaatactttcctgttctgacatcatttagatagttagctgtattatcagattagaaaccattgtaccaggctgctgaaaggaaaaggaggcaaaaagctaaacatgggatgaattctgaaccttttaacctggctgaagtacgttggtccctgttatgcaaataccttcaatcctctgctaagttcagtggaaataattttcttgaatgacaggtttattcagcaaggattcagttggtgattaatccccctttgatctagggtatttcacttaactaccagttacctcgttctgacaaagtgcaactgagattagggagatcactagaacactaccagggtgtgcgtttattctctataaccttttaaagcaagggccaagaatgcaatttattttcagtatttgaagatgtaaagtcctgtctgctaagttagaaagtcaattgaataccaaatgaagtttatttcttacgtaatagaacaaacatttctttttgcttcgcctaacaatgatattaggaaacataggctttgaagaaagaagaaacaaagactacattctaagtattgcttctagttttgtttcatgcactagggtatacttaactggccttgacataaccaaaaatcaaagcagtggctacaacttagactgagaaaatgcttctgttttattaagctgcatggtttcttctcacctttccccctaccaccaccaccaccattagaaaatgtcatactgtgtggtaaagaaatccagttgaggaaaatgtgttgcagtacacagttatccaccttaagactaatgatttcgaagctttgtta

SEQ ID NO: 9168 - DNA, 2195 bp, Homo sapiens
ccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaatatattgtttcccgcttcctgcctttcatctaagagttacggggaagaagtattacataattgtcatcactgttgtgtgttctgacaaagtaaatttgaaaataacatgaacttgatttttctaaaagtactcagtcaactcatatgtcagttatcggtacattttccatgtgttcagtcaaaagtttatctttttagtctgtttcatagcagtttatttctaagacagtttttattttaatttacttttttgtctgtacactgccactctgtaatgttccccccaccccatcccacccttggtaagacaccaaagtaaaatagagcaatatccaaagagctttttgcccctgtcttgtgaggagctttaaatagctgtgaatacttctgtatgtcaa

SEQ ID NO: 9169 - DNA, 1142 bp, Homo sapiens
atagcagggaatagctgcctggtcaaggaacgtttgatgtgaatttccatctttgttaaatgaatgatgcctttctaatttctctcttactcacacacaagttctttccttccccatctcagttatcagttatttcctttacagtcatacatttgagtatcacctctatggaactaataaaccttcctagaatccgtttttgaataatgtctggctcacaagaacattttcatcaaataattttaactctttttgccaagagatgtaagcaaatatgtgaaactgatcaagagaagtgaaaagctctgtacagtcaaatagaagttagcaactggcaaattagctcaaggtcagattttaaaaatagaattcagaatcatgacactcagaagtgatttgtaatttcacgagtagagacatcctgatattgcataagggatgttttccttttctaagagcagccctttgctgtaagtgtttctaaggttgggagtaagtgagcatggtgtggcattactgtctttgtattcttgacaaactatttgttgagaatacgtcgtaggccacttaactgagtagcacatgggtgatactagtggccattattgccttgggctactcaatctatagtcttaactaaaccatggctaataggttgaatcttcaaactgtagtgtaataaattcccaaataacagacccatattttcatttctcagaggtccgtgaggatgacatgtatgtgaattttggcttaacacagtatctctgtggtcctttttgggacacatgatttcttaaaggaaaagattatacttagagtacatttctgtacaaacccatttaaacatctggattgagtggaaggtcggtggatggtacaaatgacatgtttattttggccattttccttgctgctggtggctgtggaataatgattttcagtggttggcttagattattaagaggatcagaaaaggttgtcatattttaaacaaaacctgggattagagatgctgctacgagatggaagtgctggccagtggttatatagtggtccagttgagaagtagtaaatcaggcacttgtaggtttacccaaaataagtgacaagtatgcttatatttgcacaattaaaataga

SEQ ID NO: 9170 - DNA, 1143 bp, Homo sapiens
actaataacatatgcattccagcctgggcaacatgtaagaccccatctcttaaaacaaaacaacaaaaaaaaactgccgggtgtggtggctgaaacctgtaatcccagcactttgggaggccaaggtgggcagatcacctgaggtcagaagttgagaccagcccggccaacatggcaaaatcctgactctactaaaaatacaaaaattagccaggcatggtggtttgtgcctgtaatcccagctacttgggaggttgaggctggagaatcgcttgaacccgagagacagaggttgcagtgagctgggatcatgccactgcactccagcctgggtgatggcgaaactccatctccaaaagaaagaaagaaataaaaataaatgagcaaacaaaacttacgtttgactcaatctgggctttggtctttctcaagttatttatatttgattgtggaattctcatgaaacattgacttcttaaaaccatctttttcctagtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcaggtgagaggatgattaattgaccaattccacctcctagaagttctatgactgcagcccagtcaaaggtatttagagagcactctgacctggcaggaaggaaggcttcaatgtactctctagaatgctgtgggactttacattggtgttgtttctcttgggctatttaacagtgtatattcaaagccttaaaaaaaaaatctatccacatcctttgctctggaattccatttcttagcaattattttaaagaaataatcataaatttacacaaaaaagggcagcattctttataatagcaccaagctaaagacaacctaaatgtttaccaaaaggggatgagttctaaatgatataacagccatataatggaatatttatgcagtccttgaaagacatgtattcaaagaataatgatacagaaaaagatttctacatgaaatctttttctgttttgttttttaaggtgtgttaataca
